US008216834B2

(12) United States Patent
Colloca et al.

(10) Patent No.: US 8,216,834 B2
(45) Date of Patent: Jul. 10, 2012

(54) CHIMPANZEE ADENOVIRUS VACCINE CARRIERS

(75) Inventors: Stefano Colloca, Rome (IT); Alfredo Nicosia, Rome (IT); Elisabetta Sporeno, Rome (IT); Paolo Palazzolo, legal representative, Rome (IT); Agostino Cirillo, Rome (IT); Bruno Bruni Ercole, Rome (IT); Annalisa Meola, Rome (IT)

(73) Assignee: Istituto di Ricerche di Biologia Molecolare P. Angeletti SPA, Rome (IT)

( * ) Notice: Subject to any disclaimer, the term of this patent is extended or adjusted under 35 U.S.C. 154(b) by 1031 days.

(21) Appl. No.: 10/587,389

(22) PCT Filed: Jan. 18, 2005

(86) PCT No.: PCT/EP2005/000558
§ 371 (c)(1),
(2), (4) Date: Sep. 15, 2008

(87) PCT Pub. No.: WO2005/071093
PCT Pub. Date: Aug. 4, 2005

(65) Prior Publication Data
US 2011/0217332 A1  Sep. 8, 2011

Related U.S. Application Data

(60) Provisional application No. 60/538,799, filed on Jan. 23, 2004.

(51) Int. Cl.
*A61K 48/00* (2006.01)
*C12N 15/63* (2006.01)
*C12N 15/64* (2006.01)
*C12N 15/861* (2006.01)

(52) U.S. Cl. ............ 435/320.1; 435/325; 435/366; 435/455; 435/456; 435/69.1; 424/93.1; 424/93.2; 424/93.6

(58) Field of Classification Search ............ None
See application file for complete search history.

(56) References Cited

U.S. PATENT DOCUMENTS

| | | |
|---|---|---|
| 5,849,561 A | 12/1998 | Falck-Pedersen |
| 5,922,315 A | 7/1999 | Roy |
| 6,127,175 A | 10/2000 | Vigne et al. |
| 6,287,571 B1 | 9/2001 | Ertl et al. |
| 2004/0136963 A1* | 7/2004 | Wilson et al. ........ 424/93.2 |

FOREIGN PATENT DOCUMENTS

| | | |
|---|---|---|
| WO | 9700326 A1 | 1/1997 |
| WO | WO 9810087 | 3/1998 |
| WO | WO 03000283 | 1/2003 |
| WO | WO 03000851 | 1/2003 |
| WO | WO 03046124 | 6/2003 |
| WO | WO 2005001103 | 1/2005 |

OTHER PUBLICATIONS

Ariga et al. "New Genome Type of Adenovirus Serotype 4 Caused Nosocomial Infections Associated with Epidemic Conjunctivitis in Japan", Journal of Clinical Microbiology, 2004, vol. 42, pp. 3644-3648.
Abrahamsen et al. "Construction of an Adenovirus Type 7a E1A-Vector", Journal of Virology, 1997, vol. 71, pp. 8946-8951.
Brody et al. "Adenovirus-Mediated in Vivo Gene Transfer", Annals New York Academy of Sciences, 1994, vol. 71, pp. 90-101.
Clarke et al. "Mice Transgenic for Human Carcinoembryonic Antigen as a Model for Immunotherapy", Cancer Research, 1998, vol. 58, pp. 1469-1477.
D'Ambrosio et al. "Neutralizing antibodies against 33 human adenoviruses in normal children in Rome", 1982, Journal of Hygiene (London), vol. 89, pp. 155-161.
Fallaux et al. "New Helper Cells and Matched Early Region 1-Deleted Adenovirus Vectors Prevent Generation of Replication-Competent Adenoviruses", Human Gene Therapy, 1998, vol. 9, pp. 1909-1917.
Graham et al. "Characteristics of a Human Cell Line Transformed by DNA for Human Adenovirus Type 5", Journal of General Virology, 1977, vol. 36, pp. 59-74.
Russel "Update on adenovirus and its vectors", Journal of General Virology, 2000, vol. 81, pp. 2573-2604.
Rux et al. "Structural and Phylogenetic Analysis of Adenovirus Hexons by Use of High-Resolution X-Ray Crystallographic, Molecular Modeling, and Sequence-Based Methods", Journal of Virology, 2003, vol. 77, pp. 9553-9566.
Soudais et al. "Canine Adenovirus Type 2 Attachment and Internalization: Coxsackievirus-Adenovirus Receptor, Alternative Receptors, and an RGD-Independent Pathway", Journal of Virology, 2000, vol. 74, pp. 10639-10649.
Toogood et al. "Antipeptide antisera define neutralizing epitopes on the adenovirus hexon", Journal of General Virology, 1992, vol. 73, pp. 1429-1435.
Vogels et al. "Replication-Deficient Human Adenovirus Type 35 Vectors for Gene Transfer and Vaccination: Efficient Human Cell Infection and Bypass of Preexisting Adenovirus Immunity", Journal of Virology, 2003, vol. 77, pp. 8263-8271.
Roy, Soumitra, et al., Virology, "Complete nucleotide sequences and genome organization of four chimpanzee adenoviruses", vol. 324, pp. 361-372, 2004.

(Continued)

*Primary Examiner* — Bo Peng
(74) *Attorney, Agent, or Firm* — Alysia A. Finnegan; Sheldon O. Heber

(57) ABSTRACT

The present invention provides recombinant replication-defective adenoviral vectors derived from chimpanzee adenoviruses and methods for generating recombinant adenoviruses in human E1-expressing cell lines. The invention also provides compositions and methods suitable for use for the delivery and expression of transgenes encoding immunogens against which a boosted immune response is desired. The invention further provides methods of generating clinical grade vector stocks suitable for use in humans. In a particular embodiment the invention contemplates the use of vectors comprising transgenes which encode tumor associated antigens in vaccines and pharmaceutical compositions for the prevention and treatment of cancer.

11 Claims, 101 Drawing Sheets

OTHER PUBLICATIONS

Wigand, R., et al., Intervirology, "Chimpanzee adenoviruses are related to four subgenera of human adenoviruses", vol. 30, pp. 1-9, 1989.

Farina, Setven F., et al., Journal of Virology, "Replication-defective vector based on a chimpanzee adenovirus", vol. 75, No. 23, pp. 11603-11613, 2001.

Fitzgerald, Julie C., et al., The Journal of Immunology, "A simian replication-defective adenoviral recombinant vaccine to HIV-1 gag", vol. 170, pp. 1416-1422, 2003.

Gall, Jason G.D., et al., Journal of Virology, "Construction and characterization of hexon-chimeric adenoviruses: specification of adenovirus serotype", vol. 72, No. 12, pp. 10260-10264, 1998.

Wu, Hongju, et al., Journal of Virology, "Construction and characterization of adenovirus serotype 5 packaged by serotype 3 hexon", vol. 76, No. 24, pp. 12775-12782, 2002.

Siemens, Robert D., et al., The Journal of Immunology, vol. 166, pp. 731-735, 2001.

Crawford-Miksza, Leta, et al., Journal of Virology, vol. 70, pp. 1836-1844, 1996.

Mastrangeli, Andrea, et al., Human Gene Therapy, "Sero-switch" Adenovirus-mediated in vivo gene transfer: circumvention of anti-adenovirus humoral immune defenses against repeat adenovirus vector administration by changing the adenovirus serotype:, vol. 7, pp. 79-97, 1996.

Cohen, Christopher, J., et al., Journal of General Virology, "Chimpanzee adenovirus CV-68 adapted as a gene delivery vector interacts with the coxsackievirus and adenovirus receptor", vol. 83, pp. 151-155, 2002.

Basnight, Mint Jr., et al., American Journal of Epidemiology, "Characterization of four new adenovirus serotypes isolated from chimpanzee tissue explants", vol. 94, No. 2, 1971.

Xiang, Zhiquan, et al., Journal of Virology, "Novel, chimpanzee serotype 68-based adenoviral vaccine carrier for induction of antibodies to a transgene product", vol. 76, No. 6, pp. 2667-2675, 2002.

Willimzik, H.-F., et al., Intervirology, "Immunological relationship among adenoviruses of human, simians, and nonprimates as determined by the neutralization test", vol. 15, pp. 28-36, 1981.

Rovero, Stefania, et al., The Journal of Immunology, "DNA vaccination against rat Her-2/Neu p185 more effectively inhibits carcinogenesis than transplantable carcinomas in transgenic BALB/c mice[1,2]", vol. 165, pp. 5133-5142, 2000.

Roy, Soumitra, et al., Human Gene Therapy, "Characterization of a family of chimpanzee adenoviruses and development of molecular clones for gene transfer vectors", vol. 15, pp. 519-530, 2004.

Fattori, E., et al., Gene Therapy, "Efficient immunization of rhesus macaques with an HCV candidate vaccine by heterologous priming-boosting with novel adenoviral vectors based on different serotypes", vol. 13, pp. 1088-1096, 2006.

Pinto, Arguinaldo R., et al., The Journal of Immunology, "Induction of CD8f+T cells to an HIV-1 antigen through a prime boost regimen with heterologous E1-deleted adenoviral vaccine carriers", vol. 171, pp. 6774-6779, 2003.

* cited by examiner

```
   1 CATCATCAAT AATATACCTT ATTTTGGATT GAAGCCAATA TGATAATGAG ATGGGCGGCG
  61 CGAGGCGGGG CGCGGGGCGG GAGGCGGGTT TGGGGGCGGG CCGGCGGGCG GGGCGGTGTG
 121 GCGGAAGTGG ACTTTGTAAG TGTGGCGGAT GTGACTTGCT AGTGCCGGGC GCGGTAAAAG
 181 TGACGTTTTC CGTGCGCGAC AACGCCCCG GGAAGTGACA TTTTTCCCGC GGTTTTTACC
 241 GGATGTTGTA GTGAATTTGG GCGTAACCAA GTAAGATTTG GCCATTTTCG CGGGAAAACT
 301 GAAACGGGGA AGTGAAATCT GATTAATTTT GCGTTAGTCA TACCGCGTAA TATTTGTCTA
 361 GGGCCGAGGG ACTTTGGCCG ATTACGTGGA GGACTCGCCC AGGTGTTTTT TGAGGTGAAT
 421 TTCCGCGTTC CGGGTCAAAG TCTCCGTTTT ATTATTATAG TCAGCTGACG CGGAGTGTAT
 481 TTATACCCTC TGATCTCGTC AAGAGGCCAC TCTTGAGTGC CAGCGAGTAG AGTTTTCTCC
 541 TCTGCCGCTC TCCGCTCCGC TCCGCTCGGC TCTGACACCG GGGAAAAAAT GAGACATTTC
 601 ACCTACGATG GCGGTGTGCT CACCGGCCAG CTGGCTGCTG AGGTCCTGGA CACCCTGATC
 661 GAGGAGGTAT TGGCCGATAA TTATCCTCCC TCGACTCCTT TTGAGCCACC TACACTTCAC
 721 GAACTATACG ATCTGGATGT GGTGGGGCCC AGCGATCCGA ACGAGCAGGC GGTTTCCAGT
 781 TTTTTTCCAG AGTCCATGTT GTTGGCCAGC CAGGAGGGGG TCGAACTTGA GACCCCTCCT
 841 CCGATCGTGG ATTCCCCCGA TCCGCCGCAG CTGACTAGGC AGCCCGAGCG CTGTGCGGGA
 901 CCTGAGACTA TGCCCCAGCT GCTACCTGAG GTGATCGATC TCACCTGTAA TGAGTCTGGT
 961 TTTCCACCCA GCGAGGATGA GGACGAAGAG GGTGAGCAGT TTGTGTTAGA TTCTGTGGAA
1021 CAACCCGGGC GAGGATGCAG GTCTTGTCAA TATCACCGGA AAAACACAGG AGACTCCCAG
1081 ATTATGTGTT CTCTGTGTTA TATGAAGATG ACCTGTATGT TTATTTACAG TAAGTTTATC
1141 ATCGGTGGGC AGGTGGGCTA TAGTGTGGGT GGTGGTCTTT GGGGGGTTTT TTAATATATG
1201 TCAGGGGTTA TGCTGAAGAC TTTTTTATTG TGATTTTTAA AGGTCCAGTG TCTGAGCCCG
1261 AGCAAGAACC TGAACCGGAG CCTGAGCCTT CTCGCCCCAG GAGAAAGCCT GTAATCTTAA
1321 CTAGACCCAG CGCACCGGTA GCGAGAGGCC TCAGCAGCGC GGAGACCACC GACTCCGGTG
1381 CTTCCTCATC ACCCCCGGAG ATTCACCCCC TGGTGCCCCT ATGTCCCGTT AAGCCCGTTG
1441 CCGTGAGAGT CAGTGGGCGG CGGTCTGCTG TGGAGTGCAT TGAGGACTTG CTTTTTGATT
1501 CACAGGAACC TTTGGACTTG AGCTTGAAAC GCCCCAGGCA TTAAACCTGG TCACCTGGAC
1561 TGAATGAGTT GACGCCTATG TTTGCTTTTG AATGACTTAA TGTGTATAGA TAATAAAGAG
1621 TGAGATAATG TTTTAATTGC ATGGTGTGTT TAACTTGGGC GGAGTCTGCT GGGTATATAA
1681 GCTTCCCTGG GCTAAACTTG GTTACACTTG ACCTCATGGA GGCCTGGGAG TGTTTGGAGA
1741 ACTTTGCCGG AGTTCGTGCC TTGCTGGACG AGAGCTCTAA CAATACCTCT TGGTGGTGGA
1801 GGTATTTGTG GGGCTCTCCC CAGGGCAAGT TAGTTTGTAG AATCAAGGAG GATTACAAGT
1861 GGGAATTTGA AGAGCTTTTG AAATCCTGTG GTCAGCTATT GGATTCTTTG AATCTAGGCC
1921 ACCAGGCTCT CTTCCAGGAG AAGGTCATCA GGACTTTGGA TTTTTCCACA CCGGGGCGCA
1981 TTGCAGCCGC GGTTGCTTTT CTAGCTTTTT TGAAGGATAG ATGGAGCGAA GAGACCCACT
2041 TGAGTTCGGG CTACGTCCTG GATTTTCTGG CCATGCAACT GTGGAGAGCA TGGATCAGAC
2101 ACAAGAACAG GCTGCAACTG TTGTCTTCCG TCCGCCCGTT GCTGATTCCG GCGGAGGAGC
2161 AACAGGCCGG GTCAGAGGAC CGGGCCCGTC GGGATCCGGA GGAGAGGGCA CCGAGGCCGG
2221 GCGAGAGGAG CGCGCTGAAC CTGGGAACCG GCTGAGCGG CCATCCACAT CGGGAGTGAA
2281 TGTCGGGCAG GTGGTGGATC TTTTTCCAGA ACTGCGGCGG ATTTTGACTA TTAGGGAGGA
2341 TGGGCAATTT GTTAAGGGTC TTAAGAGGGA GAGGGGGCT TCTGAGCATA ACGAGGAGGC
2401 CAGTAATTTA GCTTTTAGCT TGATGACCAG ACACCGTCCA GAGTGCATCA CTTTTCAGCA
2461 GATTAAGGAC AATTGTGCCA ATGAGTTGGA TCTGTTGGGT CAGAAGTATA GCATAGAGCA
2521 GCTGACCACT TACTGGCTGC AGCCGGGTGA TGATCTGGAG GAAGCTATTA GGGTGTATGC
2581 TAAGGTGGCC CTGCGGCCCG ATTGCAAGTA CAAGCTCAAG GGGCTGGTGA ATATCAGGAA
2641 TTGTTGCTAC ATTTCTGGCA ACGGGGCGGA GGTGGAGATA GAGACCGAAG ACAGGGTGGC
2701 TTTCAGATGC AGCATGATGA ATATGTGGCC GGGGGTGCTG GCATGGACG GGTGGTGAT
2761 TATGAATGTG AGGTTCACGG GGCCCAACTT TAACGGCACG GTGTTTTTGG GGAACACCAA
2821 CCTGGTCCTG CACGGGGTGA GCTTCTATGG GTTTAACAAC ACCTGTGTGG AGGCCTGGAC
2881 CGATGTGAAG GTCCGCGGTT GCGCCTTTTA TGGATGTTGG AAGGCCATAG TGAGCCGCCC
2941 TAAGAGCAGG AGTTCCATTA AGAAATGCTT GTTTGAGAGG TGCACCTTGG GGATCCTGGC
3001 CGAGGGCAAC TGCAGGGTGC GCCACAATGT GGCCTCCGAG TGCGGTTGCT TCATGCTAGT
3061 CAAGAGCGTG GCGGTAATCA GCATAATAT GGTGTGCGGC AACAGCGAGG ACAAGGCCTC
3121 ACAGATGCTG ACCTGCACGG ATGGCAACTG CCACTTGCTG AAGACCATCC ATGTAACCAG
3181 CCACAGCCGG AAGGCCTGGC CCGTGTTCGA GCACAACTTG CTGACCCGCT GCTCCTTGCA
3241 TCTGGGCAAC AGGCGGGGGG TGTTCCTGCC CTATCAATGC AACTTTAGTC ACACCAAGAT
3301 CTTGCTAGAG CCCGAGAGCA TGTCCAAGGT GAACTTGAAC GGGGTGTTTG ACATGACCAT
3361 GAAGATCTGG AAGGTGCTGA GGTACGACGA GACCAGGTCC CGGTGCAGAC CTGCGCAGTG
3421 CGGGGGCAAG CATATGAGGA ACCAGCCCGT GATGCTGGAT GTGACCGAGG AGCTGAGGAC
```

FIG. 5A

```
3481  AGACCACTTG GTTCTGGCCT GCACCAGGGC CGAGTTTGGT TCTAGCGATG AAGACACAGA
3541  TTGAGGTGGG TGAGTGGGCG TGGCCTGGGG TGGTCATGAA AATATATAAG TTGGGGGTCT
3601  TAGGGTCTCT TTATTTGTGT TGCAGAGACC GCCGGAGCCA TGAGCGGGAG CAGCAGCAGC
3661  AGCAGTAGCA GCAGCGCCTT GGATGGCAGC ATCGTGAGCC CTTATTTGAC GACGCGGATG
3721  CCCCACTGGG CCGGGGTGCG TCAGAATGTG ATGGGCTCCA GCATCGACGG CCGACCCGTC
3781  CTGCCCGCAA ATTCCGCCAC GCTGACCTAT GCGACCGTCG CGGGGACGCC GTTGGACGCC
3841  ACCGCCGCCG CCGCCGCCAC CGCAGCCGCC TCGGCCGTGC GCAGCCTGGC CACGGACTTT
3901  GCATTCCTGG GACCACTGGC GACAGGGGCT ACTTCTCGGG CCGCTGCTGC CGCCGTTCGC
3961  GATGACAAGC TGACCGCCCT GCTGGCGCAG TTGGATGCGC TTACTCGGGA ACTGGGTGAC
4021  CTTTCTCAGC AGGTCATGGC CCTGCGCCAG CAGGTCTCCT CCCTGCAAGC TGGCGGGAAT
4081  GCTTCTCCCA CAAATGCCGT TTAAGATAAA TAAAACCAGA CTCTGTTTGG ATTAAAGAAA
4141  AGTAGCAAGT GCATTGCTCT CTTTATTTCA TAATTTTCCG CGCGCGATAG CCCTAGACC
4201  AGCGTTCTCG GTCGTTGAGG GTGCGGTGTA TCTTCTCCAG GACGTGGTAG AGGTGGCTCT
4261  GGACGTTGAG ATACATGGGC ATGAGCCCGT CCCGGGGGTG GAGGTAGCAC CACTGCAGAG
4321  CTTCATGCTC CGGGGTGGTG TTGTAGATGA TCCAGTCGTA GCAGGAGCGC TGGGCATGGT
4381  GCCTAAAAAT GTCCTTCAGC AGCAGGCCGA TGGCCAGGGG GAGGCCCTTG GTGTAAGTGT
4441  TTACAAAACG GTTAAGTTGG GAAGGGTGCA TTCGGGGAGA GATGATGTGC ATCTTGGACT
4501  GTATTTTTAG ATTGGCGATG TTTCCGCCCA GATCCCTTCT GGGATTCATG TTGTGCAGGA
4561  CCACCAGTAC AGTGTATCCG GTGCACTTGG GGAATTTGTC ATGCAGCTTA GAGGGAAAAG
4621  CGTGGAAGAA CTTGGAGACG CCCTTGTGGC CTCCCAGATT TTCCATGCAT TCGTCCATGA
4681  TGATGGCAAT GGGCCCGCGG GAGGCAGCTT GGGCAAAGAT ATTTCTGGGG TCGCTGACGT
4741  CGTAGTTGTG TTCCAGGGTG AGGTCGTCAT AGGCCATTTT TACAAAGCGC GGGCGGAGGG
4801  TGCCCGACTG GGGGATGATG GTCCCCTCTG GCCCTGGGGC GTAGTTGCCC TCGCAGATCT
4861  GCATTTCCCA GGCCTTAATC TCGAGGGGG GAATCATATC CACCTGCGGG GCGATGAAGA
4921  AAACGGTTTC CGGAGCCGGG GAGATTAACT GGGATGAGAG CAGGTTTCTA AGCAGCTGTG
4981  ATTTTCCACA ACCGGTGGGC CCATAAATAA CACCTATAAC CGGTTGCAGC TGGTAGTTTA
5041  GAGAGCTGCA GCTGCCGTCG TCCCGGAGGA GGGGGGCCAC CTCGTTGAGC ATGTCCCTGA
5101  CGCGCATGTT CTCCCCGACC AGATCCGCCA GAAGGCGCTC GCCGCCCAGG GACAGCAGCT
5161  CTTGCAAGGA AGCAAAGTTT TCAGCGGCT TGAGGCCGTC CGCCGTGGGC ATGTTTTCA
5221  GGGTCTGGCT CAGCAGCTCC AGGCGGTCCC AGAGCTCGGT GACGTGCTCT ACGGCATCTC
5281  TATCCAGCAT ATCTCCTCGT TTCGCGGGTT GGGGCGACTT TCGCTGTAGG GCACCAAGCG
5341  GTGGTCGTCC AGCGGGGCCA AAGTCATGTC CTTCCATGGG CGCAGGGTCC TCGTCAGGGT
5401  GGTCTGGGTC ACGGTGAAGG GGTGCGCTCC GGGCTGAGCG CTTGCCAAGG TGCGCTTGAG
5461  GCTGGTTCTG CTGGTGCTGA AGCGCTGCCG GTCTTCGCCC TGCGCGTCGG CCAGGTAGCA
5521  TTTGACCATG GTGTCATAGT CCAGCCCCTC CGCGGCGTGT CCCTTGGCGC GCAGCTTGCC
5581  CTTGGAGGTG GCGCCGCACG AGGGGCAGAG CAGGCTCTTG AGCGCGTAGA GCTTGGGGGC
5641  GAGGAAGACC GATTCGGGGG AGTAGGCGTC CGCGCCGCAG ACCCCGCACA CGGTCTCGCA
5701  CTCCACCAGC CAGGTGAGCT CGGGGCGCGC CGGGTCAAAA ACCAGGTTTC CCCCATGCTT
5761  TTTGATGCGT TTCTTACCTC GGGTCTCCAT GAGGTGGTGT CCCCGCTCGG TGACGAAGAG
5821  GCTGTCCGTG TCTCCGTAGA CCGACTTGAG GGGTCTTTTC TCCAGGGGGG TCCCTCGGTC
5881  TTCCTCGTAG AGGAACTCGG ACCACTCTGA CGCGAAGGCC CGCGTCCAGG CCAGGACGAA
5941  GGAGGCTATG TGGGAGGGGT AGCGGTCGTT GTCCACTAGG GGGTCCACCT TCTCCAAGGT
6001  GTGAAGACAC ATGTCGCCTT CCTCGGCGTC CAGGAAGGTG ATTGGCTTGT AGGTGTAGGC
6061  CACGTGACCG GGGGTTCCTG ACGGGGGGT ATAAAAGGGG GTGGGGCGC GCTCGTCGTC
6121  ACTCTCTTCC GCATCGCTGT CTGCGAGGGC CAGCTGCTGG GGTGAGTATT CCCTCTCGAA
6181  GGCGGGCATG ACCTCCGCGC TGAGGTTGTC AGTTTCCAAA AACGAGGAGG ATTTGATGTT
6241  CACCTGTCCC GAGGTGATAC CTTTGAGGGT ACCCGCGTCC ATCTGGTCAG AAAACACGAT
6301  CTTTTTATTG TCCAGCTTGG TGGCGAACGA CCCGTAGAGG GCGTTGGAGA GCAGCTTGGC
6361  GATGGAGCGC AGGGTCTGGT TCTTGTCCCT GTCGGCGCGC TCCTTGGCCG CGATGTTGAG
6421  CTGCACGTAC TCGCGCGCGA CGCAGCGCCA CTCGGGGAAG ACGGTGGTGC GCTCGTCGGG
6481  CACCAGGCGC ACGCGCCAGC CGCGGTTGTG CAGGGTGACC AGGTCCACGC TGGTGGCGAC
6541  CTCGCCGCGC AGGCGCTCGT TGGTCCAGCA GAGACGGCCC CCTTGCGCG AGCAGAAGGG
6601  GGGCAGGGGG TCGAGCTGGG TCTCGTCCGG GGGTCCGCG TCCACGGTGA AACCCCGGG
6661  GCGCAGGCGC GCGTCGAAGT AGTCTATCTT GCAACCTTGC ATGTCCAGCG CCTGCTGCCA
6721  GTCGCGGGCG GCGAGCGCGC GCTCGTAGGG GTTGAGCGGC GGGCCCCAGG GCATGGGGTG
6781  GGTGAGTGCG GAGGCGTACA TGCCGCAGAT GTCATAGACG TAGAGGGGCT CCCGCAGGAC
6841  CCCGATGTAG GTGGGGTAGC AGCGGCCGCC GCGGATGCTG GCGCGCACGT AGTCATACAG
6901  CTCGTGCGAG GGGGCGAGGA GGTCGGGGCC CAGGTTGGTG CGGGCGGGGC GCTCCGCGCG
```

FIG. 5B

```
6961  GAAGACGATC TGCCTGAAGA TGGCATGCGA GTTGGAAGAG ATGGTGGGGC GCTGGAAGAC
7021  GTTGAAGCTG GCGTCCTGCA GGCCGACGGC GTCGCGCACG AAGGAGGCGT AGGAGTCGCG
7081  CAGCTTGTGT ACCAGCTCGG CGGTGACCTG CACGTCGAGC GCGCAGTAGT CGAGGGTCTC
7141  GCGGATGATG TCATATTTAG CCTGCCCCTT CTTTTTCCAC AGCTCGCGGT TGAGGACAAA
7201  CTCTTCGCGG TCTTTCCAGT ACTCTTGGAT CGGGAAACCG TCCGGTTCCG AACGGTAAGA
7261  GCCTAGCATG TAGAACTGGT TGACGGCCTG GTAGGCGCAG CAGCCCTTCT CCACGGGGAG
7321  GGCGTAGGCC TGCGCGGCCT TGCGGAGCGA GGTGTGGGTC AGGGCGAAGG TGTCCCTGAC
7381  CATGACTTTG AGGTACTGGT GCTTGAAGTC GGAGTCGTCG CAGCCGCCCC GCTCCCAGAG
7441  CGAGAAGTCG GTGCGCTTCT TGGAGCGGGG GTTGGGCAGA GCGAAGGTGA CATCGTTGAA
7501  GAGGATTTTG CCCGCGCGGG GCATGAAGTT GCGGGTGATG CGGAAGGGCC CCGGCACTTC
7561  AGAGCGGTTG TTGATGACCT GGGCGGCGAG CACGATCTCG TCGAAGCCGT TGATGTTGTG
7621  GCCCACGATG TAGAGTTCCA GGAAGCGGGG CCGGCCCTTT ACGGTGGGCA GCTTCTTTAG
7681  CTCTTCGTAG GTGAGCTCCT CGGGCGAGGC GAGGCCGTGC TCGGCCAGGG CCCAGTCCGC
7741  GAGGTGCGGG TTGTCTCTGA GGAAGGACTC CCAGAGGTCG CGGGCCAGGA GGGTCTGCAG
7801  GCGGTCCCTG AAGGTCCTGA ACTGGCGGCC CACGGCCATT TTTTCGGGGG TGATGCAGTA
7861  GAAGGTGAGG GGGTCTTGCT GCCAGCGGTC CCAGTCGAGC TGCAGGGCGA GGTCGCGCGC
7921  GGCGGTGACC AGGCGCTCGT CGCCCCGAA TTTCATGACC AGCATGAAGG GCACGAGCTG
7981  CTTTCCGAAG GCCCCCATCC AAGTGTAGGT CTCTACATCG TAGGTGACAA AGAGGCGCTC
8041  CGTGCGAGGA TGCGAGCCGA TCGGGAAGAA CTGGATCTCC CGCCACCAGT TGGAGGAGTG
8101  GCTGTTGATG TGGTGGAAGT AGAAGTCCCG TCGCCGGGCC GAACACTCGT GCTGGCTTTT
8161  GTAAAAGCGA GCGCAGTACT GGCAGCGCTG CACGGGCTGT ACCTCCTGCA CGAGATGCAC
8221  CTTTCGCCCG CGCACGAGGA AGCCGAGGGG AAATCTGAGC CCCCCGCCTG GCTCGCGGCA
8281  TGGCTGGTGC TCTTCTACTT TGGATGCGTG TCCGTCTCCG TCTGGCTCCT CGAGGGGTGT
8341  TACGGTGGAG CGGACCACCA CGCCGCGCGA GCCGCAGGTC CAGATATCGG CGCGCGGCGG
8401  TCGGAGTTTG ATGACGACAT CGCGCAGCTG GGAGCTGTCC ATGGTCTGGA GCTCCCGCGG
8461  CGGCGGCAGG TCAGCCGGGA GTTCTTGCAG GTTCACCTCG CAGAGTCGGG CCAGGGCGCG
8521  GGGCAGGTCT AGGTGGTACC TGATCTCTAG GGGCGTGTTG GTGGCGGCGT CGATGGCTTG
8581  CAGGAGCCCG CATCCCCGGG GGGCGACGAC GGTGCCCCGC GGGGTGGTGG TGGTGGTGGT
8641  GGTGGTGGTG GTGGCGGTGC AGCTCAGAAG CGGTGCCGCG GGCGGGCCCC CGGAGGTAGG
8701  GGGGGCTCCG GTCCCGCCGG CAGGGGCGGC AGCGGCACGT CGGCGTGGAG CGCGGGCAGG
8761  AGTTGGTGCT GTGCCCGGAG GTTGCTGGCG AAGGCGACGA CGCGGCGGTT GATCTCCTGG
8821  ATCTGGCGCC TCTGCGTGAA GACGACGGGC CCGGTGAGCT TGAACCTGAA AGAGAGTTCG
8881  ACAGAATCAA TCTCGGTGTC ATTGACGCG GCCTGGCGCA GGATCTCCTG CACGTCTCCC
8941  GAGTTGTCTT GGTAGGCGAT CTCGGCCATG AACTGCTCGA TCTCTTCCTC CTGGAGGTCT
9001  CCGCGTCCGG CGCGTTCCAC GGTGGCCGCC AGGTCGTTGG AGATGCGCCC CATGAGCTGC
9061  GAGAAGGCGT TGAGTCCGCC CTCGTTCCAG ACTCGGCTGT AGACCACGCC CCCCTGGTCA
9121  TCGCGGGCGC GCATGACCAC CTGCGCGAGG TTGAGCTCCA CGTGCCGCGC GAAGACGGCG
9181  TAGTTGCGCA GACGCTGGAA GAGGTAGTTG AGGGTGGTGG CGGTGTGCTC GGCCACGAAG
9241  AAGTTCATGA CCCAGCGGCG CAACGTGGAT TCGTTGATGT CCCCCAAGGC CTCCAGCCGT
9301  TCCATGGCCT CGTAGAAGTC CACGGCGAAG TTGAAAAACT GGGAGTTGCG CGCCGACACG
9361  GTCAACTCCT CCTCCAGAAG ACGGATGAGC TCGGCGACGG TGTCGCGCAC CTCGCGCTCG
9421  AAGGCTATGG GGATCTCTTC CTCCGCTAGC ATCACCACCT CCTCCTCTTC CTCCTCTTCT
9481  GGCACTTCCA TGATGGCTTC CTCCTCTTCG GGGGCGGCG GCGGCGGCGG TGGGGAGGG
9541  GGCGCTCTGC GCCGGCGGCG GCGCACCGGG AGGCGGTCCA CGAAGCGCGC GATCATCTCC
9601  CCGCGGCGGC GGCGCATGGT CTCGGTGACG GCGCGGCCGT TCTCCGGGG GCGCAGTTGG
9661  AAGACGCCGC CGGACATCTG GTGCTGGGGC GGGTGGCCGT GAGGCAGCGA ACGGCGCTG
9721  ACGATGCATC TCAACAATTG CTGCGTAGGT ACGCCGCCGA GGACCTGAG GGAGTCCATA
9781  TCCACCGGAT CCGAAAACCT TTCGAGGAAG GCGTCTAACC AGTCGCAGTC GCAAGGTAGG
9841  CTGAGCACCG TGGCGGGCGG CGGGGGTGG GGGGAGTGTC TGGCGGAGGT GCTGCTGATG
9901  ATGTAATTGA AGTAGGCGGA CTTGACACGG CGGATGGTCG ACAGGAGCAC CATGTCCTTG
9961  GGTCCGGCCT GCTGGATGCG GAGGCGGTCG GCTATGCCCC AGGCTTCGTT CTGGCATCGG
10021 CGCAGGTCCT TGTAGTAGTC TTGCATGAGC CTTTCCACCG GCACCTCTTC TCCTTCCTCT
10081 TCTGCTTCTT CCATGTCTGC TTCGGCCCTG GGGCGGCGCC GCGCCCCCT GCCCCCCATG
10141 CGCGTGACCC CGAACCCCCT GAGCGGTTGG AGCAGGGCCA GGTCGGCGAC GACGCGCTCG
10201 GCCAGGATGG CCTGCTGCAC CTGCGTGAGG GTGGTTTGGA AGTCATCCAA GTCCACGAAG
10261 CGGTGGTAGG CGCCCGTGTT GATGGTGTAG GTGCAGTTGG CCATGACGGA CCAGTTGACG
10321 GTCTGGTGGC CCGGTTGCGA CATCTCGGTG TACCTGAGTC GCGAGTAGGC GCGGGAGTCG
10381 AAGACGTAGT CGTTGCAAGT CCGCACCAGG TACTGGTAGC CCACCAGGAA GTGCGGCGGC
```

FIG. 5C

```
10441  GGCTGGCGGT AGAGGGGCCA GCGCAGGGTG GCGGGGGCTC CGGGGGCCAG GTCTTCCAGC
10501  ATGAGGCGGT GGTAGGCGTA GATGTACCTG GACATCCAGG TGATACCCGC GGCGGTGGTG
10561  GAGGCGCGCG GGAAGTCGCG CACCCGGTTC CAGATGTTGC GCAGGGGCAG AAAGTGCTCC
10621  ATGGTAGGCG TGCTCTGTCC AGTCAGACGC GCGCAGTCGT TGATACTCTA GACCAGGGAA
10681  AACGAAAGCC GGTCAGCGGG CACTCTTCCG TGGTCTGGTG AATAGATCGC AAGGGTATCA
10741  TGGCGGAGGG CCTCGGTTCG AGCCCCGGGT CCGGGCCGGA CGGTCCGCCA TGATCCACGC
10801  GGTTACCGCC CGCGTGTCGA ACCCAGGTGT GCGACGTCAG ACAACGGTGG AGTGTTCCTT
10861  TTGGCGTTTT TCTGGCCGGG CGCCGGCGTC GCGTAAGAGA CTAAGCCGCG AAAGCGAAAG
10921  CAGTAAGTGG CTCGCTCCCC GTAGCCGGAG GGATCCTTGC TAAGGGTTGC GTTGCGGCGA
10981  ACCCCGGTTC GAATCCCGTA CTCGGGCCGG CCGGACCCGC GGCTAAGGTG TTGGATTGGC
11041  CTCCCCCTCG TATAAAGACC CCGCTTGCGG ATTGACTCCG GACACGGGGA CGAGCCCCTT
11101  TTATTTTTGC TTTCCCCAGA TGCATCCGGT GCTGCGGCAG ATGCGCCCCC CGCCCCAGCA
11161  GCAGCAACAA CACCAGCAAG AGCGGCAGCA ACAGCAGCGG GAGTCATGCA GGGCCCCCTC
11221  ACCCACCCTC GGCGGGCCGG CCACCTCGGC GTCCGCGGCC GTGTCTGGCG CCTGCGGCGG
11281  CGGCGGGGGG CCGGCTGACG ACCCCGAGGA GCCCCGCGG CGCAGGGCCA GACACTACCT
11341  GGACCTGGAG GAGGGCGAGG GCCTGGCGCG GCTGGGGCG CCGTCTCCCG AGCGCCACCC
11401  GCGGGTGCAG CTGAAGCGCG ACTCGCGCGA GGCGTACGTG CCTCGGCAGA ACCTGTTCAG
11461  GGACCGCGCG GGCGAGGAGC CCGAGGAGAT GCGGGACAGG AGGTTCAGCG CAGGGCGGGA
11521  GCTGCGGCAG GGGCTGAACC GCGAGCGGCT GCTGCGCGAG GAGGACTTTG AGCCCGACGC
11581  GCGGACGGGG ATCAGCCCCG CGCGCGCA CGTGGCGGCC GCCGACCTGG TGACGGCGTA
11641  CGAGCAGACG GTGAACCAGG AGATCAACTT CCAAAAGAGT TTCAACAACC ACGTGCGCAC
11701  GCTGGTGGCG CGCGAGGAGG TGACCATCGG GCTGATGCAC CTGTGGGACT TTGTAAGCGC
11761  GCTGGTGCAG AACCCCAACA GCAAGCCTCT GACGGCGCAG CTGTTCCTGA TAGTGCAGCA
11821  CAGCAGGGAC AACGAGGCGT TTAGGGACGC GCTGCTGAAC ATCACCGAGC CCGAGGGTCG
11881  GTGGCTGCTG GACCTGATTA ACATCCTGCA GAGCATAGTG GTGCAGGAGC GCAGCCTGAG
11941  CCTGGCCGAC AAGGTGGCGG CCATCAACTA CTCGATGCTG AGCCTGGGCA AGTTTTACGC
12001  GCGCAAGATC TACCAGACGC CGTACGTGCC CATAGACAAG GAGGTGAAGA TCGACGGTTT
12061  TTACATGCGC ATGGCGCTGA AGGTGCTCAC CCTGAGCGAC GACCTGGGCG TGTACCGCAA
12121  CGAGCGCATC CACAAGGCCG TGAGCGTGAG CCGGCGGCGC GAGCTGAGCG ACCGCGAGCT
12181  GATGCACAGC CTGCAGCGGG CGCTGGCGGG CGCCGGCAGC GGCGACAGGG AGGCGGAGTC
12241  CTACTTCGAT GCGGGGCGG ACCTGCGCTG GGCGCCCAGC CGGCGGGCCC TGGAGGCCGC
12301  GGGGGTCCGC GAGGACTATG ACGAGGACGG CGAGGAGGAT GAGGAGTACG AGCTAGAGGA
12361  GGGCGAGTAC CTGGACTAAA CCGCGGGTGG TGTTTCCGGT AGATGCAAGA CCCGAACGTG
12421  GTGGACCCGG CGCTGCGGGC GGCTCTGCAG AGCCAGCCGT CCGGCCTTAA CTCCTCAGAC
12481  GACTGGCGAC AGGTCATGGA CCGCATCATG TCGCTGACGG CGCGTAACCC GGACGCGTTC
12541  CGGCAGCAGC CGCAGGCCAA CAGGCTCTCC GCCATCCTGG AGGCGGTGGT GCCTGCGCGC
12601  TCGAACCCCA CGCACGAGAA GGTGCTGGCC ATAGTGAACG CGCTGGCCGA GAACAGGGCC
12661  ATCCGCCCGG ACGAGGCCGG GCTGGTGTAC GACGCGCTGC TGCAGCGCGT GGCCCGCTAC
12721  AACAGCGGCA ACGTGCAGAC CAACCTGGAC CGGCTGGTGG GGACGTGCG CGAGGCGGTG
12781  GCGCAGCGCG AGCGCGCGGA TCGGCAGGGC AACCTGGGCT CCATGGTGGC GCTGAATGCC
12841  TTCCTGAGCA CGCAGCCGGC CAACGTGCCG CGGGGGCAGG AAGACTACAC CAACTTTGTG
12901  AGCGCGCTGC GGCTGATGGT GACCGAGACC CCCCAGAGCG AGGTGTACCA GTCGGGCCCG
12961  GACTACTTCT TCCAGACCAG CAGACAGGGC CTGCAGACGG TGAACCTGAG CCAGGCTTTC
13021  AAGAACCTGC GGGGGCTGTG GGGCGTGAAG GCGCCCACCG GCGACCGGGC GACGGTGTCC
13081  AGCCTGCTGA CGCCCAACTC GCGCCTGCTG CTGCTGCTGA TCGCGCCGTT CACGGACAGC
13141  GGCAGCGTGT CCCGGGACAC CTACCTGGGG CACCTGCTGA CCCTGTACCG CGAGGCCATC
13201  GGGCAGGCGC AGGTGGACGA GCACACCTTC CAGGAGATCA CCAGCGTGAG CCGCGCGCTG
13261  GGGCAGGAGG ACACGAGCAG CCTGGAGGCG ACTCTGAACT ACCTGCTGAC CAACCGGCGG
13321  CAGAAGATTC CCTCGCTGCA CAGCCTGACC TCCGAGGAGG AGCGCATCTT GCGCTACGTG
13381  CAGCAGAGCG TGAGCCTGAA CCTGATGCGC GACGGGGTGA CGCCCAGCGT GGCGCTGGAC
13441  ATGACCGCGC GCAACATGGA ACCGGGCATG TACGCCGCGC ACCGGCCTTA CATCAACCGC
13501  CTGATGGACT ACCTGCATCG CGCGGCGGCC GTGAACCCCG AGTACTTTAC CAACGCCATC
13561  CTGAACCCGC ACTGGCTCCC GCCGCCCGGG TTCTACAGCG GGGCTTCGA GGTCCGGAG
13621  GCCAACGATG GCTTCCTGTG GGACGACATG GACGACAGCG TGTTCTCCCC GCGGCCGCAG
13681  GCGCTGGCGG AAGCGTCCCT GCTGCGTCCC AACAAGGAGG AGGAGGAGGC GAGTCGCCGC
13741  CGCGGCAGCA GCGGCGTGGC TTCTCTGTCC GAGCTGGGGG CGGCAGCCGC CGCGCGCCCC
13801  GGGTCCCTGG GCGGCAGCCC CTTTCCGAGC CTGGTGGGGT CTCTGCACAG CGAGCGCACC
13861  ACCCGCCCTC GGCTGCTGGG CGAGGACGAG TACCTGAATA ACTCCCTGCT GCAGCCGGTG
```

FIG. 5D

```
13921  CGGGAGAAAA ACCTGCCCCC CGCCTTCCCC AACAACGGGA TAGAGAGCCT GGTGGACAAG
13981  ATGAGCAGAT GGAAGACCTA TGCGCAGGAG CACAGGGACG CGCCCGCGCT CCGGCCGCCC
14041  ACGCGGCGCC AGCGCCACGA CCGGCAGCGG GGGCTGGTGT GGGATGACGA GGACTCCGCG
14101  GACGATAGCA GCGTGCTGGA CCTGGGAGGG AGCGGCAACC CGTTCGCGCA CCTGCGCCCC
14161  CGCCTGGGGA GGATGTTTTA AAAAAAAAAA AAGCAAGAAG CATGATGCAA AATTAAATAA
14221  AACTCACCAA GGCCATGGCG ACCGAGCGTT GGTTTCTTGT GTTCCCTTCA GTATGCGGCG
14281  CGCGGCGATG TACCAGGAGG GACCTCCTCC CTCTTACGAG AGCGTGGTGG GCGCGGCGGC
14341  GGCGGCGCCC TCTTCTCCCT TTGCGTCGCA GCTGCTGGAG CCGCCGTACG TGCCTCCGCG
14401  CTACCTGCGG CCTACGGGGG GGAGAAACAG CATCCGTTAC TCGGAGCTGG CGCCCCTGTT
14461  CGACACCACC CGGGTGTACC TGGTGGACAA CAAGTCGGCG GACGTGGCCT CCCTGAACTA
14521  CCAGAACGAC CACAGCAATT TTTTGACCAC GGTCATCCAG AACAATGACT ACAGCCCGAG
14581  CGAGGCCAGC ACCCAGACCA TCAATCTGGA TGACCGGTCG CACTGGGGCG GCGACCTGAA
14641  AACCATCCTG CACACCAACA TGCCCAACGT GAACGAGTTC ATGTTCACCA ATAAGTTCAA
14701  GGCGCGGGTG ATGGTGTCGC GCTCGCACAC CAAGGAAGAC CGGGTGGAGC TGAAGTACGA
14761  GTGGGTGGAG TTCGAGCTGC CAGAGGGCAA CTACTCCGAG ACCATGACCA TTGACCTGAT
14821  GAACAACGCG ATCGTGGAGC ACTATCTGAA AGTGGGCAGG CAAAACGGGG TCCTGGAGAG
14881  CGACATCGGG GTCAAGTTCG ACACCAGGAA CTTCCGCCTG GGCTGGACCC CGTGACCGG
14941  GCTGGTTATG CCCGGGGTGT ACACCAACGA GGCCTTCCAT CCCGACATCA TCCTGCTGCC
15001  CGGCTGCGGG GTGGACTTCA CTTACAGCCG CCTGAGCAAC CTCCTGGGCA TCCGCAAGCG
15061  GCAGCCCTTC CAGGAGGGCT TCAGGATCAC CTACGAGGAC CTGGAGGGGG CAACATCCC
15121  CGCGCTCCTC GATGTGGAGG CCTACCAGGA TAGCTTGAAG GAAAATGAGG CGGGACAGGA
15181  GGATACCACC CCCGCCGCCT CCGCCGCCGC CGAGCAGGGC GAGGATGCTG CTGACACCGC
15241  GGCCGCGGAC GGGGCAGAGG CCGACCCCGC TATGGTGGTG GAGGCTCCCG AGCAGGAGGA
15301  GGATATGAAT GACAGTGCGG TGCGCGGAGA CACCTTCGTC ACCCGGGGGG AGGAAAAGCA
15361  AGCGGAGGCC GAGGCCGCGG CCGAGGAAAA GCAACTGGCG GCAGCAGCGG CGGCGGCGGC
15421  GTTGGCCGCG GCGGAGGCTG AGTCTGAGGG GACCAAGCCC GCCAAGGAGC CCGTGATTAA
15481  GCCCCTGACC GAAGATAGCA AGAAGCGCAG TTACAACCTG CTCAAGGACA GCACCAACAC
15541  CGCGTACCGC AGCTGGTACC TGGCCTACAA CTACGGCGAC CCGTCGACGG GGGTGCGCTC
15601  CTGGACCCTG CTGTGCACGC CGGACGTGAC CTGCGGCTCG GAGCAGGTGT ACTGGTCGCT
15661  GCCCGACATG ATGCAAGAGC CCGTGACCTT CCGCTCCACG CGGCAGGTCA GCAACTTCCC
15721  GGTGGTGGGC GCCGAGCTGC TGCCCGTGCA CTCCAAGAGC TTCTACAACG ACCAGGCCGT
15781  CTACTCCCAG CTCATCCGCC AGTTCACCTC TCTGACCCAC GTGTTCAATC GCTTTCCTGA
15841  GAACCAGATT CTGGCGCGCC CGCCCGCCCC CACCATCACC ACCGTCAGTG AAAACGTTCC
15901  TGCTCTCACA GATCACGGGA CGCTACCGCT GCGCAACAGC ATCGGAGGAG TCCAGCGAGT
15961  GACCGTTACT GACGCCAGAC GCCGCACCTG CCCCTACGTT TACAAGGCCT TGGGCATAGT
16021  CTCGCCGCGC GTCCTTTCCA GCCGCACTTT TTGAGCAACA CCACCATCAT GTCCATCCTG
16081  ATCTCACCCA GCAATAACTC CGGCTGGGGA CTGCTGCGCG CGCCCAGCAA GATGTTCGGA
16141  GGGGCGAGGA AGCGTTCCGA GCAGCACCCC GTGCGCGTGC GCGGGCACTT CCGCGCCCCC
16201  TGGGGAGCGC ACAAACGCGG CCGCGCGGGG CGCACCACCG TGGACGACGC CATCGACTCG
16261  GTGGTGGAGC AGGCGCGCAA CTACAGGCCC GCGGTCTCTA CCGTGGACGC GGCCATCCAG
16321  ACCGTGGTGC GGGGCGCGCG GCGGTACGCC AAGCTGAAGA GCCGCCGGAA GCGCGTGGCC
16381  CGCCGCCACC GCCGCCGACC CGGGGCCGCC GCCAAACGCG CCGCCGCGGC CCTGCTTCGC
16441  CGGGCCAAGC GCACGGGCCC CCGCGCCGCC ATGAGGGCCG CGCCGCGCTT GGCCGCCGGC
16501  ATCACCGCCG CCACCATGGC CCCCGTACC CGAAGACGCG CGGCCGCCGC CGCCGCCGCC
16561  GCCATCAGTG ACATGGCCAG CAGGCGCCGG GGCAACGTGT ACTGGGTGCG CGACTCGGTG
16621  ACCGGCACGC GCGTGCCCGT GCGCTTCCGC CCCCCGCGGA CTTGAGATGA TGTGAAAAAA
16681  CAACACTGAG TCTCCTGCTG TTGTGTGTAT CCCAGCGGCG GCGGCGCGCG CAGCGTCATG
16741  TCCAAGCGCA AAATCAAAGA AGAGATGCTC CAGGTCGTCG CGCCGGAGAT CTATGGGCCC
16801  CCGAAGAAGG AAGAGCAGGA TTCGAAGCCC GCAAGATAA AGCGGGTCAA AAAGAAAAAG
16861  AAAGATGATG ACGATGCCGA TGGGGAGGTG GAGTTCCTGC GCGCCACGGC GCCCAGGCGC
16921  CCGGTGCAGT GGAAGGGCCG GCGCGTAAAG CGCGTCCTGC GCCCCGGCAC CGCGGTGGTC
16981  TTCACGCCCG GCGAGCGCTC CACCCGGACT TTCAAGCGCG TCTATGACGA GGTGTACGGC
17041  GACGAAGACC TGCTGGAGCA GGCCAACGAG CGCTTCGGAG AGTTTGCTTA CGGGAAGCGT
17101  CAGCGGGCGC TGGGGAAGGA GGACCTGCTG GCGCTGCCGC TGGACCAGGG CAACCCCACC
17161  CCCAGTCTGA AGCCCGTGAC CCTGCAGCAG GTGCTGCCGA GCAGCGCACC CTCCGAGGCG
17221  AAGCGGGGTC TGAAGCGCGA GGGCGGCGAC CTGGCGCCCA CCGTGCAGCT CATGGTGCCC
17281  AAGCGGCAGA GGCTGGAGGA TGTGCTGGAG AAAATGAAAG TAGACCCCGG TCTGCAGCCG
17341  GACATCAGGG TCCGTCCCAT CAAGCAGGTG GCGCCGGGCC TCGGCGTGCA GACCGTGGAC
```

FIG. 5E

```
17401  GTGGTCATCC CCACCGGCAA CTCCCCCGCC GCCACCACCA CTACCGCTGC CTCCACGGAC
17461  ATGGAGACAC AGACCGATCC CGCCGCAGCC GCAGCCGCCG CCGCAGCCGC GACCTCCTCG
17521  GCGGAGGTGC AGACGGACCC CTGGCTGCCG CCGGCGATGT CAGCTCCCCG CGCGCGCCGC
17581  GGACGCAGAA AGTACGGCGC CGCCAACGCG CTCCTGCCCG AGTACGCCTT GCATCCTTCC
17641  ATCGCGCCCA CCCCCGGCTA CCGAGGCTAT ACCTACCGCC CGCGAAGAGC CAAGGGTTCC
17701  ACCCGCCGTC CCCGCCGACG CGCCGCCGCC ACCACCCGCC GCCGCCGCCG CAGACGCCAG
17761  CCCGCACTGG CTCCAGTCTC CGTGAGGAGA GTGGCGCGCG ACGGACACAC CCTGGTGCTG
17821  CCCAGGGCGC GCTACCACCC CAGCATCGTT TAAAAGCCTG TTGTGGTTCT TGCAGATATG
17881  GCCCTCACTT GCCGCCTCCG TTTCCCGGTG CCGGGATACC GAGGAGGAAG ATCGCGCCGC
17941  AGGAGGGGTC TGGCCGGCCG CGGCCTGAGC GGAGGCAGCC GCCGCGCGCA CCGGCGGCGA
18001  CGCGCCACCA GCCGACGCAT GCGCGGCGGG GTGCTGCCCC TGTTAATCCC CCTGATCGCC
18061  GCGGCGATCG GCGCCGTGCC CGGGATCGCC TCCGTGGCCT TGCAAGCGTC CCAGAGGCAT
18121  TGACAGACTT GCAAACTTGC AAATATGGAA AAAAAAAAAA AACCCCAATA AAAAGTCTAG
18181  ACTCTCACGC TCGCTTGGTC CTGTGACTAT TTTGTAGAAT GGAAGACATC AACTTTGCGT
18241  CGCTGGCCCC GCGTCACGGC TCGCGCCCGT TCCTGGGACA CTGGAACGAT ATCGGCACCA
18301  GCAACATGAG CGGTGGCGCC TTCAGTTGGG GCTCTCTGTG GAGCGGCATT AAAAGTATCG
18361  GGTCTGCCGT TAAAAATTAC GGCTCCCGGG CCTGGAACAG CAGCACGGGC CAGATGTTGA
18421  GAGACAAGTT GAAAGAGCAG AACTTCCAGC AGAAGGTGGT GGAGGGCCTG GCCTCCGGCA
18481  TCAACGGGGT GGTGGACCTG GCCAACCAGG CCGTGCAGAA TAAAATCAAC AGCAGACTGG
18541  ACCCCCGGCC GCCGGTGGAG GAGGTGCCGC CGGCGCTGGA CACGGTGTCC CCCGATGGGC
18601  GTGGCGAGAA GCGCCCGCGG CCCGATAGGG AAGAGACCAC TCTGGTCACG CAGACCGATG
18661  AGCCGCCCCC GTATGAGGAG GCCCTAAAGC AAGGTCTGCC CACCACGCGG CCCATCGCGC
18721  CCATGGCCAC CGGGGTGGTG GGCCGCCACA CCCCCGCCAC GCTGGACTTG CCTCCGCCCG
18781  CCGATGTGCC GCAGCAGCAG AAGGCGGCAC AGCCGGGCCC GCCCGCGACC GCCTCCCGTT
18841  CCTCCGCCGG TCCTCTGCGC CGCGCGGCCA GCGGCCCCCG CGGGGGGGTC GCGAGGCACG
18901  GCAACTGGCA GAGCACGCTG AACAGCATCG TGGGTCTGGG GGTGCGGTCC GTGAAGCGCC
18961  GCCGATGCTA CTGAATAGCT TAGCTAACGT GTTGTATGTG TGTATGCGCC CTATGTCGCC
19021  GCCAGAGGAG CTGCTGAGTC GCCGCCGTTC GCGCGCCCAC CACCACCGCC ACTCCGCCCC
19081  TCAAGATGGC GACCCCATCG ATGATGCCGC AGTGGTCGTA CATGCACATC TCGGGCCAGG
19141  ACGCCTCGGA GTACCTGAGC CCCGGGCTGG TGCAGTTCGC CCGCGCCACC GAGAGCTACT
19201  TCAGCCTGAG TAACAAGTTT AGGAACCCCA CGGTGGCGCC CACGCACGAT GTGACCACCG
19261  ACCGGTCTCA GCGCCTGACG CTGCGGTTCA TTCCCGTGGA CCGCGAGGAC ACCGCGTACT
19321  CGTACAAGGC GCGGTTCACC CTGGCCGTGG GCGACAACCG CGTGCTGGAC ATGGCCTCCA
19381  CCTACTTTGA CATCCGCGGG GTGCTGGACC GGGGTCCCAC TTTCAAGCCC TACTCTGGCA
19441  CCGCCTACAA CTCCCTGGCC CCCAAGGGCG CTCCCAACTC CTGCGAGTGG GAGCAAGAGG
19501  AAACTCAGGC AGTTGAAGAA GCAGCAGAAG AGGAAGAAGA AGATGCTGAC GGTCAAGCTG
19561  AGGAAGAGCA AGCAGCTACC AAAAAGACTC ATGTATATGC TCAGGCTCCC CTTTCTGGCG
19621  AAAAAATTAG TAAAGATGGT CTGCAAATAG GAACGGACGC TACAGCTACA GAACAAAAAC
19681  CTATTTATGC AGACCCTACA TTCCAGCCCG AACCCCAAAT CGGGGAGTCC CAGTGGAATG
19741  AGGCAGATGC TACAGTCGCC GGCGGTAGAG TGCTAAAGAA ATCTACTCCC ATGAAACCAT
19801  GCTATGGTTC CTATGCAAGA CCCACAAATG CTAATGGAGG TCAGGGTGTA CTAACGGCAA
19861  ATGCCCAGGG ACAGCTAGAA TCTCAGGTTG AAATGCAATT CTTTTCAACT TCTGAAAACG
19921  CCCGTAACGA GGCTAACAAC ATTCAGCCCA AATTGGTGCT GTATAGTGAG GATGTGCACA
19981  TGGAGACCCC GGATACGCAC CTTTCTTACA AGCCCGCAAA AAGCGATGAC AATTCAAAAA
20041  TCATGCTGGG TCAGCAGTCC ATGCCCAACA GACCTAATTA CATCGGCTTC AGAGACAACT
20101  TTATCGGCCT CATGTATTAC AATAGCACTG GCAACATGGG AGTGCTTGCA GGTCAGGCCT
20161  CTCAGTTGAA TGCAGTGGTG GACTTGCAAG ACAGAAACAC AGAACTGTCC TACCAGCTCT
20221  TGCTTGATTC CATGGGTGAC AGAACCAGAT ACTTTTCCAT GTGGAATCAG GCAGTGGACA
20281  GTTATGACCC AGATGTTAGA ATTATTGAAA ATCATGGAAC TGAAGACGAG CTCCCCAACT
20341  ATTGTTTCCC TCTGGGTGGC ATAGGGGTAA CTGACACTTA CCAGGCTGTT AAAACCAACA
20401  ATGGCAATAA CGGGGGCCAG GTGACTTGGA CAAAAGATGA AACTTTTGCA GATCGCAATG
20461  AAATAGGGGT GGGAAACAAT TTCGCTATGG AGATCAACCT CAGTGCCAAC CTGTGGAGAA
20521  ACTTCCTGTA CTCCAACGTG GCGCTGTACC TACCAGACAA GCTTAAGTAC AACCCCTCCA
20581  ATGTGGACAT CTCTGACAAC CCCAACACCT ACGATTACAT GAACAAGCGA GTGGTGGCCC
20641  CGGGGCTGGT GGACTGCTAC ATCAACCTGG GCGCGCGCTG GTCGCTGGAC TACATGGACA
20701  ACGTCAACCC CTTCAACCAC CACCGCAATG CGGGCCTGCG CTACCGCTCC ATGCTCCTGG
20761  GCAACGGGCG CTACGTGCCC TTCCACATCC AGGTGCCCCA GAAGTTCTTT GCCATCAAGA
20821  ACCTCCTCCT CCTGCCGGGC TCCTACACCT ACGAGTGGAA CTTCAGGAAG GATGTCAACA
```

FIG. 5F

```
20881  TGGTCCTCCA GAGCTCTCTG GGTAACGATC TCAGGGTGGA CGGGGCCAGC ATCAAGTTCG
20941  AGAGCATCTG CCTCTACGCC ACCTTCTTCC CCATGGCCCA CAACACGGCC TCCACGCTCG
21001  AGGCCATGCT CAGGAACGAC ACCAACGACC AGTCCTTCAA TGACTACCTT TCCGCCGCCA
21061  ACATGCTCTA CCCCATACCC GCCAACGCCA CCAACGTCCC CATCTCCATC CCCTCGCGCA
21121  ACTGGGCGGC CTTCCGCGGC TGGGCCTTCA CCCGCCTCAA GACCAAGGAG ACCCCCTCCC
21181  TGGGCTCGGG ATTCGACCCC TACTACACCT ACTCGGGCTC TATTCCCTAC CTGGACGGCA
21241  CCTTCTACCT CAACCACACT TTCAAGAAGG TCTCGGTCAC CTTCGACTCC TCGGTCAGCT
21301  GGCCGGGCAA CGACCGTCTG CTCACCCCCA ACGAGTTCGA GATCAAGCGC TCGGTCGACG
21361  GGGAAGGCTA CAACGTGGCC CAGTGCAACA TGACCAAGGA CTGGTTCCTG GTCCAGATGC
21421  TGGCCAACTA CAACATCGGC TACCAGGGCT TCTACATCCC AGAGAGCTAC AAGGACAGGA
21481  TGTACTCCTT CTTCAGGAAC TTCCAGCCCA TGAGCCGGCA GGTGGTGGAC CAGACCAAGT
21541  ACAAGGACTA CCAGGAGGTG GGCATCATCC ACCAGCACAA CAACTCGGGC TTCGTGGGCT
21601  ACCTCGCCCC CACCATGCGC GAGGGACAGG CCTACCCCGC CAACTTCCCC TACCCGCTCA
21661  TAGGCAAGAC CGCGGTCGAC AGCATCACCC AGAAAAAGTT CCTCTGCGAC CGCACCCTCT
21721  GGCGCATCCC CTTCTCCAGC AACTTCATGT CCATGGGTGC GCTCTCGGAC CTGGGCCAGA
21781  ACTTGCTCTA CGCCAACTCC GCCCACGCCC TCGACATGAC CTTCGAGGTC GACCCCATGG
21841  ACGAGCCCAC CCTTCTCTAT GTTCTGTTCG AAGTCTTTGA CGTGGTCCGG GTCCACCAGC
21901  CGCACCGCGG CGTCATCGAG ACCGTGTACC TGCGTACGCC CTTCTCGGCC GGCAACGCCA
21961  CCACCTAAAG AAGCAAGCCG CAGTCATCGC CGCCTGCATG CCGTCGGGTT CCACCGAGCA
22021  AGAGCTCAGG GCCATCGTCA GAGACCTGGG ATGCGGGCCC TATTTTTTGG GCACCTTCGA
22081  CAAGCGCTTC CCTGGCTTTG TCTCCCCACA CAAGCTGGCC TGCGCCATCG TCAACACGGC
22141  CGGCCGCGAG ACCGGGGGCG TGCACTGGCT GGCCTTTGCC TGGAACCCGC GCTCCAAAAC
22201  ATGCTTCCTC TTTGACCCCT TCGGCTTTTC GGACCAGCGG CTCAAGCAAA TCTACGAGTT
22261  CGAGTACGAG GGCTTGCTGC GTCGCAGCGC CATCGCCTCC TCGCCCGACC GCTGCGTCAC
22321  CCTCGAAAAG TCCACCCAGA CCGTGCAGGG GCCCGACTCG GCCGCCTGCG GTCTCTTCTG
22381  CTGCATGTTT CTGCACGCCT TTGTGCACTG GCCTCAGAGT CCCATGGACC GCAACCCCAC
22441  CATGAACTTG CTGACGGGGG TGCCCAACTC CATGCTCCAA AGCCCCCAGG TCGAGCCCAC
22501  CCTGCGCCGC AACCAGGAGC AGCTCTACAG CTTCCTGGAG CGCCACTCGC CCTACTTCCG
22561  CCGCCACAGC GCACAGATCA GGAGGGCCAC CTCCTTCTGC CACTTGCAAG AGATGCAAGA
22621  AGGGTAATAA CGATGTACAC ACTTTTTTCT CAATAAATGG CATTTTTTTT TTATTTATAC
22681  AAGCTCTCTG GGGTATTCAT TTCCCACCAC CACCACCCGC CGTTGTCGCC ATCTGGCTCT
22741  ATTTAGAAAT CGAAAGGGTT CTGCCGGGAG TCGCCGTGCG CCACGGGCAG GGACACGTTG
22801  CGATACTGGT AGCGGGTGCC CCACTTGAAC TCGGGCACCA CCAGGCGAGG CAGCTCGGGG
22861  AAGTTTTCGC TCCACAGGCT GCGGGTCAGC ACCAGCGCGT TCATCAGGTC GGGCGCCGAG
22921  ATCTTGAAGT CGCAGTTGGG GCCGCCGCCC TGCGCGCGCG AGTTGCGGTA CACCGGGTTG
22981  CAGCACTGGA ACACCAACAG CGCCGGGTGC TTCACGCTGG CCAGCACGCT GCGGTCGGAG
23041  ATCAGCTCGG CGTCCAGGTC CTCCGCGTTG CTCAGCGCGA ACGGGGTCAT CTTGGGCACT
23101  TGCCGCCCCA GGAAGGGCGC GTGCCCCGGT TTCGAGTTGC AGTCGCAGCG CAGCGGGATC
23161  AGCAGGTGCC CGTGCCCGGA CTCGGCGTTG GGGTACAGCG CGCGCATGAA GGCCTGCATC
23221  TGGCGGAAGG CCATCTGGGC CTTGGCGCCC TCCGAGAAGA ACATGCCGCA GGACTTGCCC
23281  GAGAACTGGT TTGCGGGGCA GCTGGCGTCG TGCAGGCAGC AGCGCGCGTC GGTGTTGGCG
23341  ATCTGCACCA CGTTGCGCCC CCACCGGTTC TTCACGATCT TGGCCTTGGA CGATTGCTCC
23401  TTCAGCGCGC GCTGCCCGTT CTCGCTGGTC ACATCCATCT CGATCACATG TTCCTTGTTC
23461  ACCATGCTGC TGCCGTGCAG ACACTTCAGC TCGCCCTCCG TCTCGGTGCA GCGGTGCTGC
23521  CACAGCGCGC AGCCCGTGGG CTCGAAAGAC TTGTAGGTCA CCTCCGCGAA GGACTGCAGG
23581  TACCCCTGCA AAAGCGGCC CATCATGGTC ACGAAGGTCT TGTTGCTGCT GAAGGTCAGC
23641  TGCAGCCCGC GGTGCTCCTC GTTCAGCCAG GTCTTGCACA CGGCCGCCAG CGCCTCCACC
23701  TGGTCGGGCA GCATCTTGAA GTTCACCTTC AGCTCATTCT CCACGTGGTA CTTGTCCATC
23761  AGCGTGCGCG CCGCCTCCAT GCCCTTCTCC CAGGCCGACA CCAGCGGCAG GCTCACGGGG
23821  TTCTTCACCA TCACCGTGGC CGCCGCCTCC GCCGCGCTTT CGCTTTCCGC CCCGCTGTTC
23881  TCTTCCTCTT CCTCCTCTTC CTCGCCGCCG CCCACTCGCA GCCCCGCAC CACGGGGTCG
23941  TCTTCCTGCA GGCGCTGCAC CTTGCGCTTG CCGTTGCGCC CCTGCTTGAT GCGCACGGGC
24001  GGGTTGCTGA AGCCCACCAT CACCAGCGCG GCCTCTTCTT GCTCGTCCTC GCTGTCCAGA
24061  ATGACCTCCG GGAGGGGGG GTTGGTCATC CTCAGTACCG AGGCACGCTT CTTTTTCTTC
24121  CTGGGGGCGT CGCCAGCTC CGCGGCTGCG GCCGCTGCCG AGGTCGAAGG CCGAGGGCTG
24181  GGCGTGCGCG GCACCAGCGC GTCTTGCGAG CCGTCCTCGT CCTCCTCGGA CTCGAGACGG
24241  AGGCGGGCCC GCTTCTTCGG GGGCGCGCGG GGCGCGGAG GCGGCGGCG CGACGGAGAC
24301  GGGGACGAGA CATCGTCCAG GGTGGGTGGA CGGCGGGCCG CGCCGCGTCC GCGCTCGGGG
```

FIG. 5G

```
24361  GTGGTTTCGC GCTGGTCCTC TTCCCGACTG GCCATCTCCC ACTGCTCCTT CTCCTATAGG
24421  CAGAAAGAGA TCATGGAGTC TCTCATGCGA GTCGAGAAGG AGGAGGACAG CCTAACCGCC
24481  CCCTCTGAGC CCTCCACCAC CGCCGCCACC ACCGCCAATG CCGCCGCGGA CGACGCGCCC
24541  ACCGAGACCA CCGCCAGTAC CACCCTCCCC AGCGACGCAC CCCCGCTCGA GAATGAAGTG
24601  CTGATCGAGC AGGACCCGGG TTTTGTGAGC GGAGAGGAGG ATGAGGTGGA TGAGAAGGAG
24661  AAGGAGGAGG TCGCCGCCTC AGTGCCAAAA GAGGATAAAA AGCAAGACCA GGACGACGCA
24721  GATAAGGATG AGACAGCAGT CGGGCGGGGG AACGGAAGCC ATGATGCTGA TGACGGCTAC
24781  CTAGACGTGG GAGACGACGT GCTGCTTAAG CACCTGCACC GCCAGTGCGT CATCGTCTGC
24841  GACGCGCTGC AGGAGCGCTG CGAAGTGCCC CTGGACGTGG CGGAGGTCAG CCGCGCCTAC
24901  GAGCGGCACC TCTTCGCGCC GCACGTGCCC CCCAAGCGCC GGGAGAACGG CACCTGCGAG
24961  CCCAACCCGC GTCTCAACTT CTACCCGGTC TTCGCGGTAC CCGAGGTGCT GGCCACCTAC
25021  CACATCTTCT TCCAAAACTG CAAGATCCCC CTCTCCTGCC GCGCTAACCG CACCCGCGCC
25081  GACAAAACCC TGACCCTGCG GCAGGGCGCC CACATACCTG ATATTGCCTC TCTGGAGGAA
25141  GTGCCCAAGA TCTTCGAGGG TCTCGGTCGC GACGAGAAAC GGGCGGCGAA CGCTCTGCAC
25201  GGAGACAGCG AAAACGAGAG TCACTCGGGG GTGCTGGTGG AGCTCGAGGG CGACAACGCG
25261  CGCCTGGCCG TACTCAAGCG CAGCATAGAG GTCACCCACT TTGCCTACCC GGCGCTCAAC
25321  CTGCCCCCCA AGGTCATGAG TGTGGTCATG GGCGAGCTCA TCATGCGCCG CGCTCAGCCC
25381  CTGGCCGCGG ATGCAAACTT GCAAGAGTCC TCCGAGGAAG GCCTGCCCGC GGTCAGCGAC
25441  GAGCAGCTAG CGCGCTGGCT GGAGACCCGC GACCCCGCGC AGCTGGAGGA GCGGCGCAAG
25501  CTCATGATGG CCGCGGTGCT GGTCACCGTG GAGCTCGAGT GTCTGCAGCG CTTCTTCGCG
25561  GACCCCGAGA TGCAGCGCAA GCTCGAGGAG ACCCTGCACT ACACCTTCCG CCAGGGCTAC
25621  GTGCGCCAGG CCTGCAAGAT CTCCAACGTG GAGCTCTGCA ACCTGGTCTC CTACCTGGGC
25681  ATCCTGCACG AGAACCGCCT CGGGCAGAAC GTCCTGCACT CCACCCTCAA AGGGGAGGCG
25741  CGCCGCGACT ACATCCGCGA CTGCGCCTAC CTCTTCCTCT GCTACACCTG GCAGACGGCC
25801  ATGGGGGTCT GGCAGCAGTG CCTGGAGGAG CGCAACCTCA AGGAGCTGGA AAAGCTACTC
25861  AAGCGCACCC TCAGGGACCT CTGGACGGGC TTCAACGAGC GCTCGGTGGC CGCCGCGCTG
25921  GCGGACATCA TCTTCCCCGA GCGCCTGCTC AAGACCCTGC AGCAGGGCCT GCCCGACTTC
25981  ACCAGCCAGA GCATGCTGCA GAACTTTAGG ACTTTCATCC TGGAGCGCTC GGGCATCCTG
26041  CCTGCCACTT GCTGCGCGCT GCCCAGCGAC TTCGTGCCCA TCAAGTACAG GGAGTGCCCG
26101  CCGCCGCTCT GGGGCCACTG CTACCTCTTC CAGCTGGCCA ACTACCTCGC CTACCACTCG
26161  GACCTCATGG AAGACGTGAG CGGCGAGGGC CTGCTCGAGT GCCACTGCCG CTGCAACCTC
26221  TGCACGCCCC ACCGCTCTCT AGTCTGCAAC CCGCAGCTGC TCAGCGAGAG TCAGATTATC
26281  GGTACCTTCG AGCTGCAGGG TCCCTCGCCT GACGAGAAGT CCGCGGCTCC GGGGCTGAAA
26341  CTCACTCCGG GGCTGTGGAC TTCCGCCTAC CTACGCAAAT TTGTACCTGA GGACTACCAC
26401  GCCCACGAGA TCAGGTTCTA CGAAGACCAA TCCCGCCCGC CAAGGCGGA GCTCACCGCC
26461  TGCGTCATCA CCCAGGGGCA CATCCTGGGC CAATTGCAAG CCATCAACAA AGCCCGCCGA
26521  GAGTTCTTGC TGAAAAAGGG TCGGGGGGTG TACCTGGACC CCCAGTCCGG CGAGGAGCTA
26581  AACCCGCTAC CCCCGCCGCC GCCCCAGCAG CGGGACCTTG CTTCCCAGGA TGGCACCCAG
26641  AAAGAAGCAG CAGCCGCCGC CGCCGCAGCC ATACATGCTT CTGGAGGAAG AGGAGGAGGA
26701  CTGGACAGT CAGGCAGAGG AGGTTTCGGA CGAGGAGCAG GAGGAGATGA TGGAAGACTG
26761  GGAGGAGGAC AGCAGCCTAG ACGAGGAAGC TTCAGAGGCC GAAGAGGTGG CAGACGCAAC
26821  ACCATCACCC TCGGTCGCAG CCCCCTCGCC GGGGCCCCTG AAATCCTCCG AACCCAGCAC
26881  CAGCGCTATA ACCTCCGCTC CTCCGGCGCC GGCGCCACCC GCCCGCAGAC CCAACCGTAG
26941  ATGGGACACC ACAGGAACCG GGTCGGTAA GTCCAAGTGC CCGCCGCCGC CACCGCAGCA
27001  GCAGCAGCAG CGCCAGGGCT ACCGCTCGTG GCGCGGGCAC AAGAACGCCA TAGTCGCCTG
27061  CTTGCAAGAC TGCGGGGGCA ACATCTCTTT CGCCCGGCGC TTCCTGCTAT TCCACCACGG
27121  GGTCGCCTTT CCCCGCAATG TCCTGCATTA CTACCGTCAT CTCTACAGCC CCTACTGCAG
27181  CGGCGACCCA GAGGCGGCAG CGGCAGCCAC AGCGGCGACC ACCACCTAGG AAGATATCCT
27241  CCGCGGCCAA GACAGCGGCA GCAGCGGCCA GGAGACCCGC GGCAGGACGC GCGGGAGCGG
27301  TGGGCGCACT GCGCCTCTCG CCCAACGAAC CCCTCTCGAC CCGGGAGCTC AGACACAGGA
27361  TCTTCCCCAC TTTGTATGCC ATCTTCCAAC AGAGCAGAGG CCAGGAGCAG GAGCTGAAAA
27421  TAAAAACAG ATCTCTGCGC TCCCTCACCC GCAGCTGTCT GTATCACAAA AGCGAAGATC
27481  AGCTTCGGCG CACGCTGGAG GACGCGGAGG CACTCTTCAG CAAATACTGC GCGCTCACTC
27541  TTAAAGACTA GCTCCGCGCC CTTCTCGAAT TTAGGCGGGA GAAAACTACG TCATCGCCGG
27601  CCGCCGCCCA GCCCGCCCAG CCGAGATGAG CAAAGAGATT CCCACGCCAT ACATGTGGAG
27661  CTACCAGCCG CAGATGGGAC TCGCGGCGGG AGCGGCCCAG GACTACTCCA CCCGCATGAA
27721  CTACATGAGC GCGGGACCCC ACATGATCTC ACAGGTCAAC GGGATCCGCG CCCAGCGAAA
27781  CCAAATACTG CTGAACAGG CGGCCATCAC CGCCACGCCC CGCCATAATC TCAACCCCCG
```

FIG. 5H

```
27841  AAATTGGCCC GCCGCCCTCG TGTACCAGGA AACCCCCTCC GCCACCACCG TACTACTTCC
27901  GCGTGACGCC CAGGCCGAAG TCCAGATGAC TAACTCAGGG GCGCAGCTCG CGGGCGGCTT
27961  TCGTCACGGG GCGCGGCCGC TCCGACCAGG TATAAGACAC CTGATGATCA GAGGCCGAGG
28021  TATCCAGCTC AACGACGAGT CGGTGAGCTC TTCGCTCGGT CTCCGTCCGG ACGGAACTTT
28081  CCAGCTCGCC GGATCCGGCC GCTCTTCGTT CACGCCCCGC CAGGCGTACC TGACTCTGCA
28141  GACCTCGTCC TCGGAGCCCC GCTCCGGAGG CATCGGAACC CTCCAGTTCG TGGAGGAGTT
28201  CGTGCCCTCG GTCTACTTCA ACCCCTTCTC GGGACCTCCC GGACGCTACC CCGACCAGTT
28261  CATTCCGAAC TTTGACGCGG TGAAGGACTC GGCGGACGGC TACGACTGAA TGTCAGGTGC
28321  CGAGGCAGAG CAGCTTCGCC TGAGACACCT CGAGCACTGC CGCCGCCACA AGTGCTTCGC
28381  CCGCGGTTCC GGTGAGTTCT GCTACTTTCA GCTACCCGAG GAGCATACCG AGGGGCCGGC
28441  GCACGGCGTC CGCCTGACCA CCCAGGGCGA GGTTACCTGT TCCCTCATCC GGGAGTTCAC
28501  CCTCCGTCCC CTGCTAGTGG AGCGGGAGCG GGGTCCCTGT GTCCTAACTA TCGCCTGCAA
28561  CTGCCCTAAC CCTGGATTAC ATCAAGATCT TTGCTGTCAT CTCTGTGCTG AGTTAATAA
28621  ACGCTGAGAT CAGAATCTAC TGGGCTCCT GTCGCCATCC TGTGAACGCC ACCGTCTTCA
28681  CCCACCCCGA CCAGGCCCAG GCGAACCTCA CCTGCGGTCT GCATCGGAGG GCCAAGAAGT
28741  ACCTCACCTG GTACTTCAAC GGCACCCCCT TTGTGGTTTA CAACAGCTTC GACGGGGACG
28801  GAGTCTCCCT GAAAGACCAG CTCTCCGGTC TCAGCTACTC CATCCACAAG AACACCACCC
28861  TCCAACTCTT CCCTCCCTAC CTGCCGGGAA CCTACGAGTG CGTCACCGGC CGCTGCACCC
28921  ACCTCACCCG CCTGATCGTA AACCAGAGCT TTCCGGGAAC AGATAACTCC CTCTTCCCCA
28981  GAACAGGAGG TGAGCTCAGG AAACTCCCCG GGGACCAGGG CGGAGACGTA CCTTCGACCC
29041  TTGTGGGGTT AGGATTTTTT ATTACCGGGT TGCTGGCTCT TTTAATCAAA GCTTCCTTGA
29101  GATTTGTTCT TTCCTTCTAC GTGTATGAAC ACCTCAGCCT CCAATAACTC TACCCTTTCT
29161  TCGGAATCAG GTGACTTCTC TGAAATCGGG CTTGGTGTGC TGCTTACTCT GTTGATTTTT
29221  TTCCTTATCA TACTCAGCCT TCTGTGCCTC AGGCTCGCCC CCTGCTGCGC ACACATCTAT
29281  ATCTACTGCT GGTTGCTCAA GTGCAGGGGT CGCCACCCAA GATGAACAGG TACATGGTCC
29341  TATCGATCCT AGGCCTGCTG GCCCTGGCGG CCTGCAGCGC CGCCAAAAAA GAGATTACCT
29401  TTGAGGAGCC CGCTTGCAAT GTAACTTTCA AGCCCGAGGG TGACCAATGC ACCACCCTCG
29461  TCAAATGCGT TACCAATCAT GAGAGGCTGC GCATCGACTA CAAAAACAAA CTGGCCAGT
29521  TTGCGGTCTA TAGTGTGTTT ACGCCCGGAG ACCCCTCTAA CTACTCTGTC ACCGTCTTCC
29581  AGGGCGGACA GTCTAAGATA TTCAATTACA CTTTCCCTTT TTATGAGTTA TGCGATGCGG
29641  TCATGTACAT GTCAAAACAG TACAACCTGT GGCCTCCCTC TCCCCAGGCG TGTGTGGAAA
29701  ATACTGGGTC TTACTGCTGT ATGGCTTTGG CAATCACTAC GCTCGCTCTA ATCTGCACGG
29761  TGCTATACAT AAAATTCAGG CAGAGGCGAA TCTTTATCGA TGAAAAGAAA ATGCCTTGAT
29821  CGCTAACACC GGCTTTCTAT CTGCAGAATG AATGCAATCA CCTCCCTACT AATCACCACC
29881  ACCCTCCTTG CGATTGCCCA TGGGTTGACA CGAATCGAAG TGCCAGTGGG GTCCAATGTC
29941  ACCATGGTGG GCCCCGCCGG CAATTCCACC CTCATGTGGG AAAAATTTGT CCGCAATCAA
30001  TGGGTTCATT TCTGCTCTAA CCGAATCAGT ATCAAGCCCA GAGCCATCTG CGATGGGCAA
30061  AATCTAACTC TGATCAATGT GCAAATGATG GATGCTGGGT ACTATTACGG GCAGCGGGGA
30121  GAAATCATTA ATTACTGGCG ACCCCACAAG GACTACATGC TGCATGTAGT CGAGGCACTT
30181  CCCACTACCA CCCCACTAC CACCTCTCCC ACCACCACTA CCACCACTAC TACTACTACT
30241  ACTACCACTA CCGCTGCCCG CCATACCCGC AAAAGCACCA TGATTAGCAC AAAGCCCCCT
30301  CGTGCTCACT CCCACGCCGG CGGGCCCATC GGTGCGACCT CAGAAACCAC CGAGCTTTGC
30361  TTCTGCCAAT GCACTAACGC CAGCGCTCAT GAACTGTTCG ACCTGGAGAA TGAGGATGCC
30421  CAGCAGAGCT CCGCTTGCCT GACCCAGGAG GCTGTGGAGC CCGTTGCCCT GAAGCAGATC
30481  GGTGATTCAA TAATTGACTC TTCTTCTTTT GCCACTCCCG AATACCCTCC CGATTCTACT
30541  TTCCACATCA CGGGTACCAA AGACCCTAAC CTCTCTTTCT ACCTGATGCT GCTGCTCTGT
30601  ATCTCTGTGG TCTCTTCCGC GCTGATGTTA CTGGGGATGT TCTGCTGCCT GATCTGCCGC
30661  AGAAAGAGAA AAGCTCGCTC TCAGGGCCAA CCACTGATGC CCTTCCCCTA CCCCCCGGAT
30721  TTTGCAGATA CAAGATATG AGCTCGCTGC TGACACTAAC CGCTTTACTA GCCTGCGCTC
30781  TAACCCTTGT CGCTTGCGAC TCGAGATTCC ACAATGTCAC AGCTGTGGCA GGAGAAAATG
30841  TTACTTTCAA CTCCACGGCC GATACCCAGT GGTCGTGGAG TGGCTCAGGT AGCTACTTAA
30901  CTATCTGCAA TAGCTCCACT TCCCCCAGCA TATCCCCAAC CAAGTACCAA TGCAATGCCA
30961  GCCTGTTCAC CCTCATCAAC GCTTCCACCC TGGACAATGG ACTCTATGTA GGCTATGTAC
31021  CCTTTGGTGG GCAAGGAAAG ACCCACGCTT ACAACCTGGA AGTTCGCCAG CCCAGAACCA
31081  CTACCCAAGC TTCTCCCACC ACCACCACCA CCACCACCAC CACCATCACC AGCAGCAGCA
31141  GCAGCCACAG CAGCAGCAGC AGATTATTGA CTTTGGTTTT GGCCAGCTCA TCTGCCGCTA
31201  CCCAGGCCAT CTACAGCTCT GTGCCCGAAA CCACTCAGAT CCACCGCCCA GAAACGACCA
31261  CCGCCACCAC CCTACACACC TCCAGCGATC AGATGCCGAC CAACATCACC CCCTTGGCTC
```

FIG. 5I

```
31321  TTCAAATGGG ACTTACAAGC CCCACTCCAA AACCAGTGGA TGCGGCCGAG GTCTCCGCCC
31381  TCGTCAATGA CTGGGCGGGG CTGGGAATGT GGTGGTTCGC CATAGGCATG ATGGCGCTCT
31441  GCCTGCTTCT GCTCTGGCTC ATCTGCTGCC TCCACCGCAG GCGAGCCAGA CCCCCCATCT
31501  ATAGACCCAT CATTGTCCTG AACCCCGATA ATGATGGGAT CCATAGATTG GATGGCCTGA
31561  AAAACCTACT TTTTTCTTTT ACAGTATGAT AAATTGAGAC ATGCCTCGCA TTTTCTTGTA
31621  CATGTTCCTT CTCCCACCTT TTCTGGGGTG TTCTACGCTG GCCGCTGTGT CTCACCTGGA
31681  GGTAGACTGC CTCTCACCCT TCACTGTCTA CCTGCTTTAC GGATTGGTCA CCCTCACTCT
31741  CATCTGCAGC CTAATCACAG TAATCATCGC CTTCATCCAG TGCATTGATT ACATCTGTGT
31801  GCGCCTCGCA TACTTCAGAC ACCACCCGCA GTACCGAGAC AGGAACATTG CCCAACTTCT
31861  AAGACTGCTC TAATCATGCA TAAGACTGTG ATCTGCCTTC TGATCCTCTG CATCCTGCCC
31921  ACCCTCACCT CCTGCCAGTA CACCACAAAA TCTCCGCGCA AAAGACATGC CTCCTGCCGC
31981  TTCACCCAAC TGTGGAATAT ACCCAAATGC TACAACGAAA AGAGCGAGCT CTCCGAAGCT
32041  TGGCTGTATG GGGTCATCTG TGTCTTAGTT TTCTGCAGCA CTGTCTTTGC CCTCATGATC
32101  TACCCCTACT TTGATTTGGG ATGGAACGCG ATCGATGCCA TGAATTACCC CACCTTTCCC
32161  GCACCCGAGA TAATTCCACT GCGACAAGTT GTACCCGTTG TCGTTAATCA ACGCCCCCCA
32221  TCCCCTACGC CCACTGAAAT CAGCTACTTT AACCTAACAG GCGGAGATGA CTGACGCCCT
32281  AGATCTAGAA ATGGACGGCA TCAGTACCGA GCAGCGTCTC CTAGAGAGGC GCAGGCAGGC
32341  GGCTGAGCAA GAGCGCCTCA ATCAGGAGCT CCGAGATCTC GTTAACCTGC ACCAGTGCAA
32401  AAGAGGCATC TTTTGTCTGG TAAAGCAGGC CAAAGTCACC TACGAGAAGA CCGGCAACAG
32461  CCACCGCCTC AGTTACAAAT TGCCCACCCA GCGCCAGAAG CTGGTGCTCA TGGTGGGTGA
32521  GAATCCCATC ACCGTCACCC AGCACTCGGT AGAGACCGAG GGGTGTCTGC ACTCTCCCTG
32581  TCGGGGTCCA GAAGACCTCT GCACCCTGGT AAAGACCCTG TGCGGTCTCA GAGATTTAGT
32641  CCCCTTTAAC TAATCAAACA CTGGAATCAA TAAAAAGAAT CACTTACTTA AAATCAGACA
32701  GCAGGTCTCT GTCCAGTTTA TTCAGCAGCA CCTCCTTCCC CTCCTCCCAA CTCTGGTACT
32761  CCAAACGCCT TCTGGCGGCA AACTTCCTCC ACACCCTGAA GGGAATGTCA GATTCTTGCT
32821  CCTGTCCCTC CGCACCCACT ATCTTCATGT TGTTGCAGAT GAAGCGCACC AAAACGTCTG
32881  ACGAGAGCTT CAACCCCGTG TACCCCTATG ACACGGAAAG CGGCCCTCCC TCCGTCCCTT
32941  TCCTCACCCC TCCCTTCGTG TCTCCCGATG GATTCCAAGA AAGCCCCCCC GGGGTCCTGT
33001  CTCTGAACCT GGCCGAGCCC CTGGTCACTT CCCACGGCAT GCTCGCCCTG AAAATGGGAA
33061  GTGGCCTCTC CCTGGACGAC GCTGGCAACC TCACCTCTCA AGATATCACC ACCGCTAGCC
33121  CTCCCCTCAA AAAAACCAAG ACCAACCTCA GCCTAGAAAC CTCATCCCCC CTAACTGTAA
33181  GCACCTCAGG CGCCCTCACC GTAGCAGCCG CCGCTCCCCT GGCAGTGGCC GGCACCTCCC
33241  TCACCATGCA ATCAGAGGCC CCCCTGACAG TACAGGATGC AAAACTCACC CTGGCCACCA
33301  AAGGCCCCCT GACCGTGTCT GAAGGCAAAC TGGCCTTGCA AACATCGGCC CCGCTGACGG
33361  CCGCTGACAG CAGCACCCTC ACCGTTAGCG CCACACCACC AATTAATGTA AGCAGTGGAA
33421  GTTTAGGCTT AGACATGGAA GACCCTATGT ATACTCACGA TGGAAAACTG GGAATAAGAA
33481  TTGGGGGTCC ACTAAGAGTA GTAGACAGCT GCACACACT CACTGTAGTT ACCGGAAATG
33541  GACTAACTGT AGATAACAAT GCCCTCCAAA CTAGAGTTAC GGGCGCCCTA GGTTATGACA
33601  CATCAGGAAA TCTACAATTG AGAGCTGCAG GAGGTATGCG AATTGATGCA AATGGCCAAC
33661  TTATCCTTAA TGTGGCATAC CCATTTGATG CTCAGAACAA TCTCAGCCTT AGACTTGGTC
33721  AGGGACCCCT GTATATAAAC ACAGACCACA ACTGGATTT GAATTGCAAC AGAGGTCTAA
33781  CCACAACTAC CACCAACAAC ACAAAAAAAC TTGAGACTAA AATTAGCTCA GGCTTAGACT
33841  ATGACACCAA TGGTGCTGTC ATTATTAAAC TTGGCACTGG TCTAAGCTTC GACAACACAG
33901  GCGCCCTAAC TGTGGGAAAC ACTGGTGATG ATAAACTGAC TCTGTGGACG ACCCCAGACC
33961  CATCTCCAAA TTGCAGAATT CACTCAGACA AAGACTGCAA GTTACTCTA GTCCTAACTA
34021  AGTGTGGAAG CCAAATCCTG GCCTCTGTCG CCGCCCTAGC GGTATCAGGA ATCTGGCTT
34081  CGATAACAGG CACCGTTGCC AGCGTTACCA TCTTTCTCAG ATTTGATCAG AATGGAGTGC
34141  TTATGGAAAA CTCCTCGCTA GACAGGCAGT ACTGGAACTT CAGAAATGGC AACTCAACTA
34201  ACGCTGCCCC CTACACCAAT GCAGTTGGGT TCATGCCAAA CCTCGCAGCA TACCCCAAAA
34261  CGCAAAGCCA GACTGCTAAA AACAACATTG TAAGTCAGGT TTACTTGAAT GGAGACAAAT
34321  CCAAACCCAT GACCCTTACC ATCACCCTCA ATGGAACTAA TGAATCCAGT GAAACTAGCC
34381  AGGTGAGTCA CTACTCCATG TCATTTACAT GGGCTTGGGA AAGTGGGCAA TATGCCACTG
34441  AAACCTTTGC CACCAACTCC TTCACCTTTT CTTACATTGC TGAACAATAA AAAGCATGAC
34501  ACTGATGTTC ATTTCTGATT CTTATTTTAT TATTTTCAAA CACAACAAAA TCATTCAAGT
34561  CATTCTTCCA TCTTAGCTTA ATAGACACAG TAGCTTAATA GACCCAGTAG TGCAAAGCCC
34621  CATTCTAGCT TATAGATCAG ACAGTGATAA TTAACCACCA CCACCACCAT ACCTTTTGAT
34681  TCAGGAAATC ATGATCATCA CAGGATCCTA GTCTTCAGGC CGCCCCCTCC CTCCCAAGAC
34741  ACAGAATACA CAGTCCTCTC CCCCCGACTG GCTTTAAATA ACACCATCTG GTTGGTCACA
```

FIG. 5J

```
34801  GACATGTTCT TAGGGGTTAT ATTCCACACG GTCTCCTGCC GCGCCAGGCG CTCGTCGGTG
34861  ATGTTGATAA ACTCTCCCGG CAGCTCGCTC AAGTTCACGT CGCTGTCCAG CGGCTGAACC
34921  TCCGGCTGAC GCGATAACTG TGCGACCGGC TGCTGGACAA ACGGAGGCCG CGCCTACAAG
34981  GGGGTAGAGT CATAATCCTC GGTCAGGATA GGGCGGTGAT GCAGCAGCAG CGAGCGAAAC
35041  ATCTGCTGCC GCCGCCGCTC CGTCCGGCAG GAAAACAACA AGCCGGTGGT CTCCTCCGCG
35101  ATAATCCGCA CCGCCCGCAG CATCAGCTTC CTCGTTCTCC GCGCGCAGCA CCTCACCCTG
35161  ATCTCGCTCA AGTCGGCGCA GTAGGTACAG CACAGCACCA CGATGTTATT CATGATCCCA
35221  CAGTGCAGGG CGCTGTATCC AAAGCTCATG CCGGGAACCA CCGCCCCAC GTGGCCATCG
35281  TACCACAAGC GCACGTAAAT TAAGTGTCGA CCCCTCATGA ACGTGCTGGA CACAAACATT
35341  ACTTCCTTGG GCATGTTGTA ATTCACCACC TCCCGGTACC AGATAAACCT CTGGTTAAAC
35401  AGGGCACCTT CCACCACCAT CCTGAACCAA GAGGCCAGAA CCTGCCCACC GGCTATGCAC
35461  TGCAGGGAAC CCGGGTTGGA ACAATGACAA TGCAGACTCC AAGGCTCGTA ACCGTGGATC
35521  ATCCGGCTGC TGAAGGCATC GATGTTGGCA CAACACAGAC ACACGTGCAT GCACTTTCTC
35581  ATGATTAGCA GCTCTTCCCT CGTCAGGATC ATATCCCAAG GAATAACCCA TTCTTGAATC
35641  AACGTAAAAC CCACACAGCA GGGAAGGCCT CGCACATAAC TCACGTTGTG CATGGTCAGC
35701  GTGTTGCATT CTGGAAACAG CGGATGATCC TCCAGTATCG AGGCGCGGGT CTCCTTCTCA
35761  CAGGGAGGTA AAGGGTCCCT GCTGTACGGA CTGCGCCGGG ACGACCGAGA TCGTGTTGAG
35821  CGTAGTGTCA TGGAAAAGGG AACGCCGGAC GTGGTCATAC TTCTTGAAGC AGAACCAGGT
35881  TCGCGCGTGG CAGGCCTCCT TGCGTCTGCG GTCTCGCCGT CTAGCTCGCT CCGTGTGATA
35941  GTTGTAGTAC AGCCACTCCC GCAGAGCGTC GAGGCGCACC CTGGCTTCCG GATCTATGTA
36001  GACTCCGTCT TGCACCGCGG CCCTGATAAT ATCCACCACC GTAGAATAAG CAACACCCAG
36061  CCAAGCAATA CACTCGCTCT GCGAGCGGCA GACAGGAGGA GCGGGCAGAG ATGGGAGAAC
36121  CATGATAAAA AACTTTTTTT AAAGAATATT TTCCAATTCT TCGAAAGTAA GATCTATCAA
36181  GTGGCAGCGC TCCCCTCCAC TGGCGCGGTC AAACTCTACG GCCAAAGCAC AGACAACGGC
36241  ATTTCTAAGA TGTTCCTTAA TGGCGTCCAA AAGACACACC GCTCTCAAGT TGCAGTAAAC
36301  TATGAATGAA AACCCATCCG GCTGATTTTC CAATATAGAC GCGCCGGCGG CGTCCACCAA
36361  ACCCAGATAA TTTTCTTCTC TCCAGCGGTT TAGAATCTGT CTAAGCAAAT CCCTTATATC
36421  AAGTCCGGCC ATGCCAAAAA TCTGCTCAAG AGCGCCCTCC ACCTTCATGA CCAAGCAGCG
36481  CATCATGATT GCAAAAATTC AGGTTCTTCA GAGACCTGTA TAAGATTCAA AATGGGAACA
36541  TTAACAAAAA TTCCTCTGTC GCGCAGATCC CTTCGCAGGG CAAGCTGAAC ATAATCAGAC
36601  AGGTCTGAAC GGACCAGTGA GGCCAAATCC CCACCAGGAA CCAGATCCAG AGACCCTATA
36661  CTGATTATGA CGCGCATACT CGGGGCTATG CTGACCAGCG TAGCGCCGAT GTAGGCGTGC
36721  TGCATGGGCG GCGAGATAAA ATGCAAAGTG CTGGTTAAAA AATCAGGCAA AGCCTCGCGC
36781  AAAAAAGCTA ACACATCATA ATCATGCTCA TGCAGGTAGT TGCAGGTAAG CTCAGGAACC
36841  AAAACGGAAT AACACACGAT TTTCCTCTCA AACATGACTT CGCGGATACT GCGTAAAACA
36901  AAAATTATAA ATAAAAAATT AATTAACTTA AACATTGGAA GCCTGTCTCA ACACAGGAAA
36961  AACCACTTTA ATCAACATAA GACGGGCCAC GGGCATGCCG GCATAGCCGT AAAAAAATTG
37021  GTCCCCGTGA TTAACAAGTA CCACAGACAG CTCCCCGGTC ATGTCGGGGG TCATCATGTG
37081  AGACTCTGTA TACACGTCTG GATTGTGAAC ATCAGACAAA CAAAGAAATC GAGCCACGTA
37141  GCCCGGAGGT ATAATCACCC GCAGGCGGAG GTACAGCAAA ACGACCCCCA TAGGAGGAAT
37201  CACAAAATTA GTAGGAGAAA AAAATACATA ACACCAGAA AAACCCTGTT GCTGAGGCAA
37261  AATAGCGCCC TCCCGATCCA AAACAACATA AAGCGCTTCC ACAGGAGCAG CCATAACAAA
37321  GACCCGAGTC TTACCAGTAA AAGAAAAAAG ATCTCTCAAC GCAGCACCAG CACCAACACT
37381  TCGCAGTGTA AAAGGCCAAG TGCCAGAGA GTATATATAG GAATAAAAAG TGACGTAAAC
37441  GGGCAAAGTC CAAAAAACGC CCAGAAAAAC CGCACGCGAA CCTACGCCCC GAAACGAAAG
37501  CCAAAAAACA CTAGACACTC CCTTCCGGCG TCAACTTCCG CTTTCCCACG CTACGTCACT
37561  TGCCCCAGTC AAACAAACTA CATATCCCGA ACTTCCAAGT CGCCACGCCC AAAACACCGC
37621  CTACACCTCC CCGCCCGCCG GCCCGCCCCC AAACCCGCCT CCCGCCCCGC GCCCCGCCTC
37681  GCGCCGCCCA TCTCATTATC ATATTGGCTT CAATCCAAAA TAAGGTATAT TATTGATGAT
37741  G         (SEQ ID NO: 1)
```

FIG. 5K

```
   1 CATCATCAAT AATATACCTC AAACTTTTGG TGCGCGTTAA TATGCAAATG AGCCGTTTGA
  61 ATTTGGGGAT GCGGGGCGCT GATTGGCTGC GGGAGCGGCG ACCGTTAGGG GCGGGGCGGG
 121 TGACGTTTTG ATGACGTGTT TGTGAGGCGG AGCCGGTTTG CAAGTTCTCG TGGGAAAAGT
 181 GACGTCAAAC GAGGTGTGGT TTGAACACGG AAATACTCAA TTTTCCCGCG CTCTCTGACA
 241 GGAAATGAGG TGTTTCTGGG CGGATGCAAG TGAAAACGGG CCATTTTCGC GCGAAAACTG
 301 AATGAGGAAG TGAAAATCTG AGTAATTTCG CGTTTATGGC AGGGAGGAGT ATTTGCCGAG
 361 GGCCGAGTAG ACTTTGACCG ATTACGTGGG GGTTTCGATT ACCGTATTTT TCACCTAAAT
 421 TTCCGCGTAC GGTGTCAAAG TCCGGTGTTT TTACGTAGGC GTCAGCTGAT CGCCAGGGTA
 481 TTTAAACCTG CGCTCTCTAG TCAAGAGGCC ACTCTTGAGT GCCAGCGAGT AGAGTTTTCT
 541 CCTCCGCGCC GCGAGTCAGA TCTACACTTT GAAAGATGAG GCACCTGAGA GACCTGCCCG
 601 GTAATGTTTT CCTGGCTACT GGGAACGAGA TTCTGGAACT GGTGGTGGAC GCCATGATGG
 661 GTGACGACCC TCCTGAGCCC CCTACCCCAT TTGAGGCGCC TTCGCTGTAC GATTTGTATG
 721 ATCTGGAGGT GGATGTGCCC GAGAACGACC CCAACGAGGA GGCGGTGAAT GATTTGTTTA
 781 GCGATGCCGC GCTGCTGGCC GCCGAGCAGG CTAATACGGA CTCTGGCTCA GACAGCGATT
 841 CCTCTCTCCA TACCCCGAGA CCCGGCAGAG GTGAGAAAAA GATCCCCGAG CTTAAAGGGG
 901 AAGAGCTCGA CCTGCGCTGC TATGAGGAAT GCTTGCCTCC GAGCGATGAT GAGGAGGACG
 961 AGGAGGCGAT TCGAGCTGCA GCGAGCGAGG GAGTGAAAGC TGCGGGCGAG AGCTTTAGCC
1021 TGGACTGTCC TACTCTGCCC GGACACGGCT GTAAGTCTTG TGAATTTCAT CGCATGAATA
1081 CTGGAGATAA GAATGTGATG TGTGCCCTGT GCTATATGAG AGCTTACAAC CATTGTGTTT
1141 ACAGTAAGTG TGATTAACTT TAGCTGGGAA GGCAGAGGGT GACTGGGTGC TGACTGGTTT
1201 ATTTATGTAT ATGTTTTTTA TGTGTAGGTC CCGTCTCTGA CGTAGATGAG ACCCCCACTT
1261 CAGAGTGCAT TTCATCACCC CCAGAAATTG GCGAGGAACC GCCCGAAGAT ATTATTCATA
1321 GACCAGTTGC AGTGAGAGTC ACCGGGCGGA GAGCAGCTGT GGAGAGTTTG GATGACTTGC
1381 TACAGGGTGG GGATGAACCT TTGGACTTGT GTACCCGGAA ACGCCCCAGG CACTAAGTGC
1441 CACACATGTG TGTTTACTTA AGGTGATGTC AGTATTTATA GGGTGTGGAG TGCAATAAAA
1501 TCCGTGTTGA CTTTAAGTGT GTGGTTTATG ACTCAGGGGT GGGGACTGTG GGTATATAAG
1561 CAGGTGCAGA CCTGTGTGGT CAGTTCAGAG CAGGACTCAT GGAGATCTGG ACGGTCTTGG
1621 AAGACTTTCA CCAGACTAGA CAGCTGCTAG AGAACTCATC GGAGGAAGTC TCTTACCTGT
1681 GGAGATTTTG CTTCGGTGGG GCTCTAGCTA AGCTAGTCTA TAGGGCCAAA CAGGATTATA
1741 AGGATCAATT TGAGGATATT TTGAGAGAGT GTCCTAGTAT TTTTGACTCT CTCAACTTGG
1801 GCCATCAGTC TCACTTTAAC CAGAGTATTC TGAGAGCCCT TGACTTTTCT ACTCCTGGCA
1861 GAACTACCGC CGCGGTAGCC TTTTTTGCCT TTATTCTTGA CAAATGGAGT CAAGAAACCC
1921 ATTTCAGCAG GGATTACCGT CTGGACTGCT TAGCAGTAGC TTTGTGGAGA ACATGGAGGT
1981 GCCAGCGCCT GAATGCAATC TCCGGCTACT TGCCAGTACA GCCGGTAGAC ACGCTGAGGA
2041 TCCTGAGTCT CCAGTCACCC CAGGAACACC AACGCCGCCA GCAGCCGCAG CAGGAGCAGC
2101 AGCAAGAGGA GGAGGAGGAG GAGGACCGAG AAGAGAACCC GAGAGCCGGT CTGGACCCTC
2161 CGGTGGCGGA GGAGGAGGAG TAGCTGACTT GTTTCCCGAG CTGCGCCGGG TGCTGACTAG
2221 GTCTTCCAGT GGACGGGAGA GGGGGATTAA GCGGGAGAGG CATGAGGAGA CTAGTCACAG
2281 AACTGAACTG ACTGTCAGTC TGATGAGCCG CAGGCGCCCA GAATCGGTGT GGTGGCATGA
2341 GGTTCAGTCG CAGGGGATAG ATGAGGTCTC GGTAATGCAT GAGAAATATT CCCTAGAACA
2401 AGTCAAGACT TGTTGGTTGG AGCCCGAGGA TGATTGGGAG GTAGCCATCA GGAATTATGC
2461 CAAGCTGGCT CTGAGGCCAG ACAAGAAGTA CAAGATTACC AAACTGATTA ATATCAGAAA
2521 TTCCTGCTAC ATTTCGGGGA ATGGGGCCGA GGTGGAGATC AGTACCCAGG AGAGGGTGGC
2581 CTTCAGATGT TGTATGATGA ATATGTACCC GGGGGTGGTG GGCATGGAGG GAGTCACCTT
2641 TATGAACGCG AGGTTTAGGG GTGATGGGTA TAATGGGGTG GTCTTTATGG CCAACACCAA
2701 GCTGACAGTG CACGGATGCT CCTTCTTTGG CTTCAATAAC ATGTGCATCG AGGCCTGGGG
2761 CAGTGTTTCA GTGAGGGGAT GCAGCTTTTC AGCCAACTGG ATGGGGGTCG TGGGCAGAAC
2821 CAAGAGCGTG GTGTCAGTGA AGAAATGCCT GTTCGAGAGG TGCCACCTGG GGGTGATGAG
2881 CGAGGGCGAA GCCAAAGTCA AACACTGCGC CTCTACCGAG ACGGGCTGCT TTGTGATGAT
2941 CAAGGGCAAT GCCAAAGTCA AGCATAACAT GATTTGTGGG GCCTCGGATG AGCGCGGCTA
3001 CCAGATGCTG ACCTGTGCCG GTGGGAACAG CCATATGCTG GCCACCGTGC ATGTGGCCTC
3061 GCACCCCGC AAGACATGGC CCGAGTTCGA GCACAACGTC ATGACCCGCT GCAATGTGCA
3121 CCTGGGGTCC CGCCGAGGCA TGTTCATGCC CTACCAGTGC AACATGCAAT TTGTGAAGGT
3181 GCTGCTGGAG CCCGATGCCA TGTCCAGAGT GAGCCTGGTG GGGGTGTTTG ACATGAATGT
3241 GGAGGTGTGG AAAATTCTGA GATATGATGA ATCCAAGACC AGGTGCCGGG CCTGCGAATG
3301 CGGAGGCAAG CACGCCAGGC TTCAGCCCGT GTGTGTGGAG GTGACGGAGG ACCTGCGACC
3361 CGATCATTTG GTGTTGTCCT GCAACGGGAC GGAGTTCGGC TCCAGCGGGG AAGAATCTGA
```

FIG. 6A

```
3421 CTAGAGTGAG TAGTGTTTGG GGGTGGGTGG GAGTCTGCAT GATGGGCAGA ATGACTAAAA
3481 TCTGTGTTTT TCTGCGCAGC AGCATGAGCG GAAGCGCCTC CTTTGAGGGA GGGGTATTCA
3541 GCCCTTATCT GACGGGGCGT CTCCCCTCCT GGGCGGGAGT GCGTCAGAAT GTGATGGGAT
3601 CCACGGTGGA CGGCCGGCCC GTGCAGCCCG CGAACTCTTC AACCCTGACC TACGCGACCC
3661 TGAGCTCCTC GTCCGTGGAC GCAGCTGCCG CCGCAGCTGC TGCTTCCGCC GCCAGCGCCG
3721 TGCGCGGAAT GGCCTTGGGC GCCGGCTACT ACAGCTCTCT GGTGGCCAAC TCGAGTTCCA
3781 CCAATAATCC CGCCAGCCTG AACGAGGAGA AGCTGCTGCT GCTGATGGCC CAGCTCGAGG
3841 CCCTGACCCA GCGCCTGGGC GAGCTGACCC AGCAGGTGGC TCAGCTGCAG GCGGAGACGC
3901 GGGCCGCGGT TGCCACGGTG AAAACCAAAT AAAAAATGAA TCAATAAATA AACGGAGACG
3961 GTTGTTGATT TTAACACAGA GTCTTGATCT TTATTTGATT TTTCGCGCGC GGTAGGCCCT
4021 GGACCACCGG TCTCGATCAT TGAGCACCCG GTGGATTTTT CCAGGACCC GGTAGAGGTG
4081 GGCTTGGATG TTGAGGTACA TGGGCATGAG CCCGTCCCGG GGTGGAGGT AGCTCCATTG
4141 CAGGGCCTCG TGCTCGGGGG TGGTGTTGTA AATCACCCAG TCATAGCAGG GGCGCAGGGC
4201 GTGGTGCTGC ACGATGTCCT TGAGGAGGAG ACTGATGGCC ACGGGCAGCC CCTTGGTGTA
4261 GGTGTTGACG AACCTGTTGA GCTGGGAGGG ATGCATGCGG GGGAGATGA GATGCATCTT
4321 GGCCTGGATC TTGAGATTGG CGATGTTCCC GCCCAGATCC CGCCGGGGGT TCATGTTGTG
4381 CAGGACCACC AGCACGGTGT ATCCGGTGCA CTTGGGGAAT TGTCATGCA ACTTGGAAGG
4441 GAAGGCGTGA AAGAATTTGG AGACGCCCTT GTGACCGCCC AGGTTTTCCA TGCACTCATC
4501 CATGATGATG GCGATGGGCC CGTGGGCGGC GGCCTGGGCA AAGACGTTTC GGGGGTCGGA
4561 CACATCGTAG TTGTGGTCCT GGGTGAGCTC GTCATAGGCC ATTTTAATGA ATTTGGGGCG
4621 GAGAGTGCCC GACTGGGGGA CGAAGGTGCC CTCGATCCCG GGGCGTAGT TCCCCTCGCA
4681 GATCTGCATC TCCCAGGCCT TGAGCTCGGA GGGGGGGATC ATGTCCACCT GCGGGGCGAT
4741 GAAAAAAACG GTTTCCGGGG CGGGGGAGAT GAGCTGGGCC GAAAGCAGGT TCCGGAGCAG
4801 CTGGGACTTG CCGCAGCCGG TGGACCGTA GATGACCCCG ATGACCGGCT GCAGGTGGTA
4861 GTTGAGGGAG AGACAGCTGC CATCCTCGCG GAGGAGGGGG GCCACCTCGT TCATCATCTC
4921 GCGCACATGC ATGTTCTCGC GCACGAGTTC CGCCAGGAGG CGCTCGCCCC CAGCGAGAG
4981 GAGCTCTTGC AGCGAGGCGA AGTTTTTCAG CGGCTTGAGC CCGTCGGCCA TGGGCATTTT
5041 GGAGAGGGTC TGTTGCAAGA GTTCCAGACG GTCCCAGAGC TCGGTGATGT GCTCTAGGGC
5101 ATCTCGATCC AGCAGACCTC CTCGTTTCGC GGGTTGGGGC GACTGCGGGA GTAGGGCACC
5161 AGGCGATGGG CGTCCAGCGA GGCCAGGGTC CGGTCCTTCC AGGGTCGCAG GGTCCGCGTC
5221 AGCGTGGTCT CCGTCACGGT GAAGGGGTGC GCGCCGGGCT GGGCGCTTGC GAGGGTGCGC
5281 TTCAGGCTCA TCCGGCTGGT CGAGAACCGC TCCCGGTCGG CGCCCTGCGC GTCGGCCAGG
5341 TAGCAATTGA GCATGAGTTC GTAGTTGAGC GCCTCGGCCG CGTGGCCCTT GGCGCGGAGC
5401 TTACCTTTGG AAGTGTGTCC GCAGACGGGA CAGAGGAGGG ACTTGAGGGC GTAGAGCTTG
5461 GGGGCGAGGA AGACGGACTC GGGGGCGTAG GCGTCCGCGC CGCAGCTGGC GCAGACGGTC
5521 TCGCACTCCA CGAGCCAGGT GAGGTCGGGG CGGTCGGGGT CAAAAACGAG GTTTCCTCCG
5581 TGCTTTTTGA TGCGTTTCTT ACCTCTGGTC TCCATGAGCT CGTGTCCCCG CTGGGTGACA
5641 AAGAGGCTGT CCGTGTCCCC GTAGACCGAC TTTATGGGCC GGTCCTCGAG CGGGGTGCCG
5701 CGGTCCTCGT CGTAGAGGAA CCCCGCCCAC TCCGAGACGA AGGCCCGGGT CCAGGCCAGC
5761 ACGAAGGAGG CCACGTGGGA GGGGTAGCGG TCGTTGTCCA CCAGCGGGTC CACCTTCTCC
5821 AGGGTATGCA AGCACATGTC CCCCTCGTCC ACATCCAGGA AGGTGATTGG CTTGTAAGTG
5881 TAGGCCACGT GACCGGGGGT CCCGGCCGGG GGGGTATAAA AGGGGCGGG CCCCTGCTCG
5941 TCCTCACTGT CTTCCGGATC GCTGTCCAGG AGCGCCAGCT GTTGGGGTAG GTATTCCCTC
6001 TCGAAGGCGG GCATGACCTC GGCACTCAGG TTGTCAGTTT CTAGAAACGA GGAGGATTTG
6061 ATATTGACGG TGCCGTTGGA CGCCTTTC ATGAGCCCCT CGTCCATCTG GTCAGAAAAG
6121 ACGATCTTTT TGTTGTCGAG CTTGGTGGCG AAGGAGCCGT AGGGGCGTT GGAGAGGAGC
6181 TTGGCGATGG AGCGCATGGT CTGGTTCTTT TCCTTGTCGG CGCGCTCCTT GGCGGCGATG
6241 TTGAGCTGCA CGTACTCGCG CGCCACGCAC TTCCATTCGG GAAGACGGT GGTGAGCTCG
6301 TCGGGCACGA TTCTGACCCG CCAGCCGCGG TTGTGCAGGG TGATGAGGTC ACGCTGGTG
6361 GCCACCTCGC CGCGCAGGGG CTCGTTGGTC CAGCAGAGGC GCCGCCCTT GCGCGAGCAG
6421 AAGGGGGGCA GCGGGTCCAG CATGAGCTCG TCTGGGGGGT CGGCGTCCAC GGTGAAGATG
6481 CCGGGCAGGA GCTCGGGGTC GAAGTAGCTG ATGGAAGTGG CCAGATCGTC CAGGGAAGCT
6541 TGCCAGTCGC GCACGGCCAG CGCGCGCTCG TAGGGCTGA GGGCGTGCC CCAGGGCATG
6601 GGGTGCGTGA GCGCGGAGGC GTACATGCCG CAGATGTCGT AGACGTAGAG GGGCTCCTCG
6661 AGGATGCCGA TGTAGGTGGG GTAGCAGCGC CCCCGCGGA TGCTGGCGCG CACGTAGTCG
6721 TACAGCTCGT GCGAGGGCGC GAGGAGCCCC GTGCCGAGAT GGAGCGCTG CGGCTTTTCG
6781 GCGCGGTAGA CGATCTGGCG GAAGATGGCG TGGGAGTTGG AGGAGATGGT GGGCCTCTGG
```

FIG. 6B

```
6841  AAGATGTTGA AGTGGGCGTG GGGCAGGCCG ACCGAGTCCC TGATGAAGTG GGCGTAGGAG
6901  TCCTGCAGCT TGGCGACGAG CTCGGCGGTG ACGAGGACGT CCAGGGCGCA GTAGTCGAGG
6961  GTCTCTTGGA TGATGTCATA CTTGAGCTGG CCCTTCTGCT TCCACAGCTC GCGGTTGAGA
7021  AGGAACTCTT CGCGGTCCTT CCAGTACTCT TCGAGGGGA ACCCGTCCTG ATCGGCACGG
7081  TAAGAGCCCA CCATGTAGAA CTGGTTGACG GCCTTGTAGG CGCAGCAGCC CTTCTCCACG
7141  GGGAGGGCGT AAGCTTGCGC GGCCTTGCGC AGGGAGGTGT GGGTGAGGGC GAAGGTGTCG
7201  CGCACCATGA CCTTGAGGAA CTGGTGCTTG AAGTCGAGGT CGTCGCAGCC GCCCTGCTCC
7261  CAGAGTTGGA AGTCCGTGCG CTTCTTGTAG GCGGGGTTGG GCAAAGCGAA AGTAACATCG
7321  TTGAAGAGGA TCTTGCCCGC GCGGGGCATG AAGTTGCGAG TGATGCGGAA AGGCTGGGGC
7381  ACCTCGGCCC GGTTGTTGAT GACCTGGGCG GCGAGGACGA TCTCGTCGAA GCCGTTGATG
7441  TTGTGCCCGA CGATGTAGAG TTCCACGAAT CGCGGGCGGC CCTTGACGTG GGGCAGCTTC
7501  TTGAGCTCGT CGTAGGTGAG CTCGGCGGGG TCGCTGAGCC CGTGCTGTTC GAGGGCCCAG
7561  TCGGCGACGT GGGGGTTGGC GCTGAGGAAG GAAGTCCAGA GATCCACGGC CAGGGCGGTC
7621  TGCAAGCGGT CCCGGTACTG ACGGAACTGC TGGCCCACGG CCATTTTTTC GGGGGTGACG
7681  CAGTAGAAGG TGCGGGGGTC GCCGTGCCAG CGGTCCCACT TGAGCTGGAG GGCGAGGTCG
7741  TGGGCGAGCT CGACGAGCGG TGGGTCCCCG GAGAGTTTCA TGACCAGCAT GAAGGGGACG
7801  AGCTGCTTGC CGAAGGACCC CATCCAGGTG TAGGTTTCCA CATCGTAGGT GAGGAAGAGC
7861  CTTTCGGTGC GAGGATGCGA GCCGATGGGG AAGAACTGGA TCTCCTGCCA CCAGTTGGAG
7921  GAATGGCTGT TGATGTGATG GAAGTAGAAA TGCCGACGGC GCGCCGAGCA CTCGTGCTTG
7981  TGTTTATACA AGCGTCCGCA GTGCTCGCAA CGCTGCACGG GATGCACGTG CTGCACGAGC
8041  TGTACCTGAG TTCCTTTGAC GAGGAATTTC AGTGGGCAGT GGAGCGCTGG CGGCTGCATC
8101  TGGTGCTGTA CTACGTCCTG GCCATCGGCG TGGCCATCGT CTGCCTCGAT GGTGGTCATG
8161  CTGACGAGGC CGCGCGGGAG GCAGGTCCAG ACCTCGGCTC GGACGGGTCG GAGAGCGAGG
8221  ACGAGGGCGC GCAGGCCGGA GCTGTCCAGG GTCCTGAGAC GCTGCGGAGT CAGGTCAGTG
8281  GGCAGCGGCG GCGCGCGGTT GACTTGCAGG AGCTTTTCCA GGGCGCGCGG GAGGTCCAGA
8341  TGGTACTTGA TCTCCACGGC GCCGTTGGTG GCGACGTCCA CGGCTTGCAG GGTCCCGTGC
8401  CCCTGGGGCG CCACCACCGT GCCCCGTTTC TTCTTGGGCG CTGGTTCCAT GCCGGTCAGA
8461  AGCGGCGGCG AGGACGCGCG CCGGGCGGCA GGGGCGGCTC GGGGCCCGGA GGCAGGGGCG
8521  GCAGGGGCAC GTCGGCGCCG CGCGCGGGCA GGTTCTGGTA CTGCGCCCGG AGAAGACTGG
8581  CGTGAGCGAC GACGCGACGG TTGACGTCCT GGATCTGACG CCTCTGGGTG AAGGCCACGG
8641  GACCCGTGAG TTTGAACCTG AAAGAGAGTT CGACAGAATC AATCTCGGTA TCGTTGACGG
8701  CGGCCTGCCG CAGGATCTCT TGCACGTCGC CCGAGTTGTC CTGGTAGGCG ATCTCGGTCA
8761  TGAACTGCTC GATCTCCTCC TCCTGAAGGT CTCCGCGGCC GGCGCGCTCG ACGGTGGCCG
8821  CGAGGTCGTT GGAGATGCGG CCCATGAGCT GCGAGAAGGC GTTCATGCCG GCCTCGTTCC
8881  AGACGCGGCT GTAGACCACG GCTCCGTCGG GGTCGCGCGC GCGCATGACC ACCTGGGCGA
8941  GGTTGAGCTC GACGTGGCGC GTGAAGACCG CGTAGTTGCA GAGGCGCTGG TAGAGGTAGT
9001  TGAGCGTGGT GGCGATGTGC TCGGTGACGA AGAAGTACAT GATCCAGCGG CGGAGCGGCA
9061  TCTCGCTGAC GTCGCCCAGG GCTTCCAAGC GCTCCATGGC CTCGTAGAAG TCCACGGCGA
9121  AGTTGAAAAA CTGGGAGTTG CGCGCCGAGA CGGTCAACTC CTCCTCCAGA AGACGGATGA
9181  GCTCGGCGAT GGTGGCGCGC ACCTCGCGCT CGAAGGCCCC GGGGGGCTCC TCTTCTTCCA
9241  TCTCCTCCTC CTCTTCCTCC TCCACTAACA TCTCTTCTAC TTCCTCCTCA GGAGGCGGTG
9301  GCGGGGGAGG GGCCCTGCGT CGCCGGCGGC GCACGGGCAG ACGGTCGATG AAGCGCTCGA
9361  TGGTCTCCCC GCGCCGGCGA CGCATGGTCT CGGTGACGGC GCGCCCGTCC TCGCGGGGCC
9421  GCAGCGTGAA GACGCCGCCG CGCATCTCCA GGTGGCCGCC GGGGGGGTCT CCGTTGGGCA
9481  GGGAGAGGGC GCTGACGATG CATCTTATCA ATTGGCCCGT AGGGACTCCG CGCAAGGACC
9541  TGAGCGTCTC GAGATCCACG GGATCCGAAA ACCGCTGAAC GAAGGCTTCG AGCCAGTCGC
9601  AGTCGCAAGG TAGGCTGAGC CCGGTTTCTT CGGGTATTTG GTCGGGAGGC GGGCGGGCGA
9661  TGCTGCTGGT GATGAAGTTG AAGTAGGCGG TCCTGAGACG GCGGATGGTG GCGAGGAGCA
9721  CCAGGTCCTT GGGCCCGGCT TGCTGGATGC GCAGACGGTC GGCCATGCCC CAGGCGTGGT
9781  CCTGACACCT GGCGAGGTCC TTGTAGTAGT CCTGCATGAG CCGCTCACG GGCACCTCCT
9841  CCTCGCCCGC GCGGCCGTGC ATGCGCGTGA GCCCGAACCC GCGCTGCGGC TGGACGAGCG
9901  CCAGGTCGGC GACGACGCGC TCGGCGAGGA TGGCCTGCTG GATCTGGGTG AGGGTGGTCT
9961  GGAAGTCGTC GAAGTCGACG AAGCGGTGGT AGGCTCCGGT GTTGATGGTG TATGAGCAGT
10021 TGGCCATGAC GGACCAGTTG ACGGTCTGGT GGCCGGGGCG CACGAGCTCG TGGTACTTGA
10081 GGCGCGAGTA GGCGCGCGTG TCGAAGATGT AGTCGTTGCA GGTGCGCACG AGGTACTGGT
10141 ATCCGACGAG GAAGTGCGGC GGCGGCTGGC GGTAGAGCGG CCATCGCTCG GTGGCGGGGG
10201 CGCCGGGCGC GAGGTCCTCG AGCATGAGGC GGTGGTAGCC GTAGATGTAC CTGGACATCC
```

FIG. 6C

```
10261  AGGTGATGCC GGCGGCGGTG GTGGAGGCGC GCGGGAACTC GCGGACGCGG TTCCAGATGT
10321  TGCGCAGCGG CAGGAAGTAG TTCATGGTGG CCGCGGTCTG GCCCGTGAGG CGCGCGCAGT
10381  CGTGGATGCT CTATACGGGC AAAAACGAAA GCGGTCAGCG GCTCGACTCC GTGGCCTGGA
10441  GGCTAAGCGA ACGGGTTGGG CTGCGCGTGT ACCCCGGTTC GAATCTCGAA TCAGGCTGGA
10501  GCCGCAGCTA ACGTGGTACT GGCACTCCCG TCTCGACCCA AGCCTGCACA AAACCTCCAG
10561  GATACGGAGG CGGGTCGTTT TGCAACTTTT TGAGGCCGGA AATGAAACTA GTAAGCGCGA
10621  AAAGCGGCCG ACCGCGATGG CTCGCTGCCG TAGTCTGGAG AAGAATCGCC AGGGTTGCGT
10681  TGCGGTGTGC CCCGGTTCGA GGCCGGCCGG ATTCCGCGGC TAACGAGGGC GTGGCTGCCC
10741  CGTCGTTTCC AAGACCCCTA GCCAGCCGAC TTCTCCAGTT ACGGAGCGAG CCCCTCTTTT
10801  GTTTTGTTTG TTTTTGCCAG ATGCATCCCG TACTGCGGCA GATGCGCCCC CACCACCCTC
10861  CACCGCAACA ACAGCCCACT CCACAGCCGG CGCTTCTGCC CCCGCCCCAG CAGCAGCAAC
10921  TTCCAGCCAC GACCGCCGCG GCCGCCGTGA GCGGGCTGG  ACAGACTTCT CAGTATGACC
10981  ACCTGGCCTT GGAAGAGGGC GAGGGGCTGG CGCGCCTGGG GGCGTCGTCG CCGGAGCGGC
11041  ACCCGCGCGT GCAGATGAAA CGGGACGCTC GCGAGGCCTA CGTGCCCAAG CAGAACCTGT
11101  TCAGAGACAG GAGCGGCGAG GAGCCCGAGG AGATGCGCGC GGCCCGGTTC CACGCGGGGC
11161  GGGAGCTGCG GCGCGGCCTG GACCGAAAGA GGGTGCTGAG GGACGAGGAT TTCGAGGCGG
11221  ACGAGCTGAC GGGGATCAGC CCCGCGCGCG CGCACGTGGC CGCGGCCAAC CTGGTCACGG
11281  CGTACGAGCA GACCGTGAAG GAGGAGAGCA ACTTCCAAAA ATCCTTCAAC AACCACGTGC
11341  GCACCCTGAT CGCGCGCGAG GAGGTGACCC TGGGCCTGAT GCACCTGTGG GACCTGCTGG
11401  AGGCCATCGT GCAGAACCCC ACCAGCAAGC CGCTGACGGC GCAGCTGTTC CTGGTGGTGC
11461  AGCACAGTCG GGACAACGAG GCGTTCAGGG AGGCGCTGCT GAATATCACC GAGCCCGAGG
11521  GCCGCTGGCT CCTGGACCTG GTGAACATTC TGCAGAGCAT CGTGGTGCAG GAGCGCGGGC
11581  TGCCGCTGTC CGAGAAGCTG GCGGCCATCA ACTTCTCGGT GCTGAGTCTG GGCAAGTACT
11641  ACGCTAGGAA GATCTACAAG ACCCCGTACG TGCCCATAGA CAAGGAGGTG AAGATCGACG
11701  GGTTTTACAT GCGCATGACC CTGAAAGTGC TGACCCTGAG CGACGATCTG GGGGTGTACC
11761  GCAACGACAG GATGCACCGC GCGGTGAGCG CCAGCCGCCG GCGCGAGCTG AGCGACCAGG
11821  AGCTGATGCA CAGCCTGCAG CGGGCCCTGA CCGGGCCGG  GACCGAGGGG GAGAGCTACT
11881  TTGACATGGG CGCGGACCTG CGCTGGCAGC CCAGCCGCCC GGCCTTGGAA GCTGCCGGCG
11941  GTTCCCCCTA CGTGGAGGAG GTGGACGATG AGGAGGAGGA GGGCGAGTAC CTGGAAGACT
12001  GATGGCGCGA CCGTATTTTT GCTAGATGCA GCAACAGCCA CCGCCGCCTC CTGATCCCGC
12061  GATGCGGGCG GCGCTGCAGA GCCAGCCGTC CGGCATTAAC TCCTCGGACG ATTGGACCCA
12121  GGCCATGCAA CGCATCATGG CGCTGACGAC CCGCAATCCC GAAGCCTTTA GACAGCAGCC
12181  TCAGGCCAAC CGGCTCTCGG CCATCCTGGA GGCCGTGGTG CCCTCGCGCT CGAACCCCAC
12241  GCACGAGAAG GTGCTGGCCA TCGTGAACGC GCTGGTGGAG AACAAGGCCA TCCGCGGCGA
12301  CGAGGCCGGG CTGGTGTACA ACGCGCTGCT GGAGCGCGTG GCCCGCTACA ACAGCACCAA
12361  CGTGCAGACG AACCTGGACC GCATGGTGAC CGACGTGCGC GAGGCGGTGT CGCAGCGCGA
12421  GCGGTTCCAC CGCGAGTCGA ACCTGGGCTC CATGGTGGCG CTGAACGCCT TCCTGAGCAC
12481  GCAGCCCGCC AACGTGCCCC GGGGCCAGGA GGACTACACC AACTTCATCA GCGCGCTGCG
12541  GCTGATGGTG GCCGAGGTGC CCCAGAGCGA GGTGTACCAG TCGGGGCCGG ACTACTTCTT
12601  CCAGACCAGT CGCCAGGGCT TGCAGACCGT GAACCTGAGC CAGGCTTTCA AGAACTTGCA
12661  GGGACTGTGG GGCGTGCAGG CCCCGGTCGG GGACCGCGCG ACGGTGTCGA GCCTGCTGAC
12721  GCCGAACTCG CGCCTGCTGC TGCTGCTGGT GGCGCCCTTC ACGGACAGCG GCAGCGTGAG
12781  CCGCGACTCG TACCTGGGCT ACCTGCTTAA CCTGTACCGC GAGGCCATCG GCAGGCGCA
12841  CGTGGACGAG CAGACCTACC AGGAGATCAC CCACGTGAGC CGCGCGCTGG GCCAGGAGGA
12901  CCCGGGCAAC TGGAGGCCA  CCCTGAACTT CCTGCTGACC AACCGGTCGC AGAAGATCCC
12961  GCCCCAGTAC GCGCTGAGCA CCGAGGAGGA GCGCATCCTG CGCTACGTGC AGCAGAGCGT
13021  GGGGCTGTTC CTGATGCAGG AGGGGGCCAC GCCCAGCGCC GCGCTCGACA TGACCGCGCG
13081  CAACATGGAG CCCAGCATGT ACGCCCGCAA CCGCCCGTTC ATCAATAAGC TGATGGACTA
13141  CTTGCATCGG GCGGCCGCCA TGAACTCGGA CTACTTTACC AACGCCATCT TGAACCCGCA
13201  CTGGCTCCCG CCGCCGGGT  TCTACACGGG CGAGTATGAC ATGCCCGACC CAACGACGG
13261  GTTCCTGTGG GATGACGTGG ACAGCAGCGT GTTCTCGCCG CGCCCCGCCA CCACCGTGTG
13321  GAAGAAAGAG GGCGGGGACC GGCGGCCGTC CTCGGCGCTG TCCGGTCGCG GGGTGCTGC
13381  CGCGGCGGTG CCCGAGGCCG CCAGCCCCTT CCCGAGCCTG CCCTTTTCGC TGAACAGCGT
13441  GCGCAGCAGC GAGCTGGGAC GGCTGACGCG GCCGCGCCTG CTGGGCGAGG AGGAGTACCT
13501  GAACGACTCC TTGTTGAGGC CCGAGCGCGA AAGAACTTC  CCAATAACG  GGATAGAGAG
13561  CCTGGTGGAC AAGATGAGCC GCTGGAAGAC GTACGCGCAC GAGCACAGGG ACGAGCCGCG
13621  AGCTAGCAGC AGCACCGGCG CCCGTAGACG CCAGCGGCAC GACAGGCAGC GGGGACTGGT
```

FIG. 6D

```
13681  GTGGGACGAT GAGGATTCCG CCGACGACAG CAGCGTGTTG GACTTGGGTG GGAGTGGTGG
13741  TGGTAACCCG TTCGCTCACC TGCGCCCCCG TATCGGGCGC CTGATGTAAG AATCTGAAAA
13801  AATAAAAAAC GGTACTCACC AAGGCCATGG CGACCAGCGT GCGTTCTTCT CTGTTGTTTG
13861  TAGTAGTATG ATGAGGCGCG TGTACCCGGA GGGTCCTCCT CCCTCGTACG AGAGCGTGAT
13921  GCAGCAGGCG GTGGCGGCGG CGATGCAGCC CCCGCTGGAG GCGCCTTACG TGCCCCCGCG
13981  GTACCTGGCG CCTACGGAGG GGCGGAACAG CATTCGTTAC TCGGAGCTGG CACCCTTGTA
14041  CGATACCACC CGGTTGTACC TGGTGGACAA CAAGTCGGCG GACATCGCCT CGCTGAACTA
14101  CCAGAACGAC CACAGCAACT TCCTGACCAC CGTGGTGCAG AACAACGATT TCACCCCCAC
14161  GGAGGCCAGC ACCCAGACCA TCAACTTTGA CGAGCGCTCG CGGTGGGGCG CCAGCTGAA
14221  AACCATCATG CACACCAACA TGCCCAACGT GAACGAGTTC ATGTACAGCA ACAAGTTCAA
14281  GGCGCGGGTC ATGGTCTCGC GCAAGACCCC CAACGGGGTC GCGGTAGGGG ATGATTATGA
14341  TGGTAGTCAG GACGAGCTGA CCTACGAGTG GGTGGAGTTT GAGCTGCCCG AGGGCAACTT
14401  CTCGGTGACC ATGACCATCG ATCTGATGAA CAACGCCATC ATCGACAATT ACTTGGCGGT
14461  GGGACGGCAG AACGGGGTGC TGGAGAGCGA CATCGGCGTG AAGTTCGACA CGCGCAACTT
14521  CCGGCTGGGC TGGGACCCCG TGACCGAGCT GGTGATGCCG GGCGTGTACA CCAACGAGGC
14581  CTTCCACCCC GACATCGTCC TGCTGCCCGG CTGCGGCGTG GACTTCACCG AGAGCCGCCT
14641  CAGCAACCTG CTGGGCATCC GCAAGCGGCA GCCCTTCCAG GAGGGCTTCC AGATCCTGTA
14701  CGAGGACCTG GAGGGGGGCA ACATCCCCGC GCTCTTGGAT GTCGAAGCCT ATGAAGAAAG
14761  TAAGGAAAAA GCAGAGGCTG AGGCAACTGC AGCCGTGGCT ACTGCCGCTG TCACCGATGC
14821  AGATGCAGCT ACTACCAGGG GCGATACATT CGCCACTGTG GCTGAAGAAG CAGCCGCCGT
14881  AGCGGCGACC GATGATAGTG AAAGTAAGAT AGTCATCAAG CCGGTGGAGA AGGACAGCAA
14941  GAACAGGAGC TACAACGTTC TATCGGATGG AAAGAACACC GCCTACCGCA GCTGGTACCT
15001  GGCCTACAAC TACGGCGACC CCGAGAAGGG CGTGCGCTCC TGGACGCTGC TCACCACCTC
15061  GGACGTCACC TGCGGCGTGG AGCAAGTCTA CTGGTCGCTG CCCGACATGA TGCAAGACCC
15121  GGTCACCTTC CGCTCCACGC GTCAAGTTAG CAACTACCCG GTGGTGGGCG CCGAGCTCCT
15181  GCCCGTCTAC TCCAAGAGCT TCTTCAACGA GCAGGCCGTC TACTCGCAGC AGCTGCGCGC
15241  CTTCACCTCG CTCACGCACG TCTTCAACCG CTTCCCCGAG AACCAGATCC TCGTCCGCCC
15301  GCCCGCGCCC ACCATTACCA CCGTCAGTGA AAACGTTCCT GCTCTCACAG ATCACGGGAC
15361  CCTGCCGCTG CGCAGCAGTA TCCGGGGAGT CCAGCGCGTG ACCGTCACTG ACGCCAGACG
15421  CCGCACCTGC CCCTACGTCT ACAAGGCCCT GGGCGTAGTC GCGCCGCGCG TCCTCTCGAG
15481  CCGCACCTTC TAAAAAATGT CCATTCTCAT CTCGCCCAGT AATAACACCG GTTGGGGCCT
15541  GCGCGCGCCC AGCAAGATGT ACGGAGGCGC TCGCCAACGC TCCACGCAAC ACCCCGTGCG
15601  CGTGCGCGGG CACTTCCGCG CTCCCTGGGG CGCCCTCAAG GGCCGCGTGC GCTCGCGCAC
15661  CACCGTCGAC GACGTGATCG ACCAGGTGGT GGCCGACGCG CGCAACTACA CGCCCGCCGC
15721  CGCGCCCGTC TCCACCGTGG ACGCCGTCAT CGACAGCGTG GTGGCCGACG CGCGCCGGTA
15781  CGCCCGCGCC AAGAGCCGGC GGCGGCGCAT CGCCCGGCGG CACCGGAGCA CCCCCGCCAT
15841  GCGCGCGGCG CGAGCCTTGC TGCGCAGGGC CAGGCGCACG GACGCAGGG CCATGCTCAG
15901  GGCGGCCAGA CGCGCGGCCT CTGGCAGCAG CAGCGCCGGC AGGACCCGCA GACGCGCGGC
15961  CACGGCGGCG GCGGCGGCCA TCGCCAGCAT GTCCCGCCCG CGGCGCGGCA ACGTGTACTG
16021  GGTGCGCGAC GCCGCCACCG TGTGCGCGT GCCCGTGCGC ACCCGCCCCC CTCGCACTTG
16081  AAGATGCTGA CTTCGCGATG TTGATGTGTC CAGCGGCGA GGAGGATGTC CAAGCGCAAA
16141  TTCAAGGAAG AGATGCTCCA GGTCATCGCG CCTGAGATCT ACGGCCCCGC GGCGGCGGTG
16201  AAGGAGGAAA GAAAGCCCCG CAAACTGAAG CGGGTCAAAA AGGACAAAAA GGAGGAGGAA
16261  GATGTGGACG GACTGGTGGA GTTTGTGCGC GAGTTCGCCC CCGGCGGCG CGTGCAGTGG
16321  CGCGGGCGGA AAGTGAAACC GGTGCTGCGA CCCGGCACCA CCGTGGTCTT CACGCCCGGC
16381  GAGCGTTCCG GCTCCGCCTC CAAGCGCTCC TACGACGAGG TGTACGGGGA CGAGGACATC
16441  CTCGAGCAGG CGGCCGAGCG TCTGGGCGAG TTTGCTTACG GCAAGCGCAG CCGCCCCGCG
16501  CCCTTGAAAG AGGAGGCGGT GTCCATCCCG CTGGACCACG GCAACCCCAC GCCGAGTCTG
16561  AAGCCGGTGA CCCTGCAGCA GGTGCTGCCG AGCGCGGCGC CGCGCCGGGG CTTCAAGCGC
16621  GAGGGCGGCG AGGATCTGTA CCCGACCATG CAGCTGATGG TGCCCAAGCG CCAGAAGCTG
16681  GAGGACGTGC TGGAGCACAT GAAGGTGGAC CCCGAGGTGC AGCCCGAGGT CAAGGTGCGG
16741  CCCATCAAGC AGGTGGCCCC GGGCCTGGGC GTGCAGACCG TGGACATCAA GATCCCCACG
16801  GAGCCCATGG AAACGCAGAC CGAGCCCGTG AAGCCCAGCA CCAGCACCAT GGAGGTGCAG
16861  ACGGATCCCT GGATGCCGGC GCCGGCTTCC ACCACCACCA CTCGCCGAAG ACGCAAGTAC
16921  GGCGCGGCCA GCTGCTGATG CCCAACTAC GCGCTGCATC CTTCCATCAT CCCCACGCCG
16981  GGCTACCGCG GCACGCGCTT CTACCGCGGC TACAGCAGCC GCCGCAAGAC CACCACCCGC
17041  CGCCGCCGTC GTCGCACCCG CCGCAGCAGC ACCGCGACTT CCGCCGCCTT GGTGCGGAGA
```

FIG. 6E

```
17101  GTGTACCGCA  GCGGGCGCGA  GCCTCTGACC  CTGCCGCGCG  CGCGCTACCA  CCCGAGCATC
17161  GCCATTTAAC  TCTGCCGTCG  CCTCCTACTT  GCAGATATGG  CCCTCACATG  CCGCCTCCGC
17221  GTCCCCATTA  CGGGCTACCG  AGGAAGAAAG  CCGCGCCGTA  GAAGGCTGAC  GGGGAACGGG
17281  CTGCGTCGCC  ATCACCACCG  GCGGCGGCGC  GCCATCAGCA  AGCGGTTGGG  GGGAGGCTTC
17341  CTGCCCGCGC  TGATCCCCAT  CATCGCCGCG  GCGATCGGGG  CGATCCCCGG  CATAGCTTCC
17401  GTGGCGGTGC  AGGCCTCTCA  GCGCCACTGA  GACACAGCTT  GGAAAATTTG  TAATAAAAAA
17461  TGGACTGACG  CTCCTGGTCC  TGTGATGTGT  GTTTTTAGAT  GGAAGACATC  AATTTTTCGT
17521  CCCTGGCACC  GCGACACGGC  ACGCGGCCGT  TTATGGGCAC  CTGGAGCGAC  ATCGGCAACA
17581  GCCAACTGAA  CGGGGGCGCC  TTCAATTGGA  GCAGTCTCTG  GAGCGGGCTT  AAGAATTTCG
17641  GGTCCACGCT  CAAAACCTAT  GGCAACAAGG  CGTGGAACAG  CAGCACAGGG  CAGGCGCTGA
17701  GGGAAAAGCT  GAAAGAGCAG  AACTTCCAGC  AGAAGGTGGT  CGATGGCCTG  GCCTCGGGCA
17761  TCAACGGGGT  GGTGGACCTG  GCCAACCAGG  CCGTGCAGAA  ACAGATCAAC  AGCCGCCTGG
17821  ACGCGGTCCC  GCCCGCGGGG  TCCGTGGAGA  TGCCCCAGGT  GGAGGAGGAG  CTGCCTCCCC
17881  TGGACAAGCG  CGGCGACAAG  CGACCGCGTC  CCGATGCAGA  GGAGACGCTG  CTGACGCACA
17941  CGGACGAGCC  GCCCCCGTAC  GAGGAGGCGG  TGAAACTGGG  TCTGCCCACC  ACGCGGCCCG
18001  TGGCGCCTCT  GGCCACCGGG  GTGCTGAAAC  CCAGCAGCAG  CAGCCAGCCC  GCGACCCTGG
18061  ACTTGCCTCC  GCCTGCTTCC  CGCCCCTCCA  CAGTGGCTAA  GCCCCTGCCG  CCGGTGGCCG
18121  TCGCGTCGCG  CGCCCCCCGA  GGCCGCCCCC  AGGCGAACTG  GCAGAGCACT  CTGAACAGCA
18181  TCGTGGGTCT  GGGAGTGCAG  AGTGTGAAGC  GCCGCCGCTG  CTATTAAAAG  ACACTGTAGC
18241  GCTTAACTTG  CTTGTCTGTG  TGTATATGTA  TGTCCGCCGA  CCAGAAGGAA  GAGGCGCGTC
18301  GCCGAGTTGC  AAGATGGCCA  CCCCATCGAT  GCTGCCCCAG  TGGGCGTACA  TGCACATCGC
18361  CGGACAGGAC  GCTTCGGAGT  ACCTGAGTCC  GGGTCTGGTG  CAGTTCGCCC  GCGCCACAGA
18421  CACCTACTTC  AGTCTGGGGA  CAAGTTTAG  GAACCCCACG  GTGGCGCCCA  CGCACGATGT
18481  GACCACCGAC  CGCAGCCAGC  GGCTGACGCT  GCGCTTCGTG  CCCGTGGACC  GCGAGGACAA
18541  CACCTACTCG  TACAAAGTGC  GCTACACGCT  GGCCGTGGGC  GACAACCGCG  TGCTGGACAT
18601  GGCCAGCACC  TACTTTGACA  TCCGCGGCGT  GCTGGATCGG  GGCCCCAGCT  TCAAACCCTA
18661  CTCCGGCACC  GCCTACAACA  GCCTGGCTCC  CAAGGGAGCG  CCCAACACCT  CACAGTGGAT
18721  AACCAAAGAC  AATGGAACTG  ATAAGACATA  CAGTTTTGGA  AATGCTCCAG  TCAGAGGATT
18781  GGACATTACA  GAAGAGGGTC  TCCAAATAGG  ACCCGATGAG  TCAGGGGGTG  AAAGCAAGAA
18841  AATTTTTGCA  GACAAAACCT  ATCAGCCTGA  ACCTCAGCTT  GGAGATGAGG  AATGGCATGA
18901  TACTATTGGA  GCTGAAGACA  AGTATGGAGG  CAGAGCGCTT  AAACCTGCCA  CCAACATGAA
18961  ACCCTGCTAT  GGGTCTTTCG  CCAAGCCAAC  TAATGCTAAG  GGAGGTCAGG  CTAAAAGCAG
19021  AACCAAGGAC  GATGGCACTA  CTGAGCCTGA  TATTGACATG  GCCTTCTTTG  ACGATCGCAG
19081  TCAGCAAGCT  AGTTTCAGTC  CAGAACTTGT  TTTGTATACT  GAGAATGTCG  ATCTGGACAC
19141  CCCGGATACC  CACATTATTT  ACAAACCTGG  CACTGATGAA  ACAAGTTCTT  CTTTCAACTT
19201  GGGTCAGCAG  TCCATGCCCA  ACAGACCCAA  CTACATCGGC  TTCAGAGACA  ACTTTATCGG
19261  TCTCATGTAC  TACAACAGTA  CTGGCAATAT  GGGTGTACTA  GCTGGACAGG  CCTCCCAGCT
19321  GAATGCTGTG  GTGGACTTGC  AGGACAGAAA  CACTGAACTG  TCCTACCAGC  TCTTGCTTGA
19381  CTCTCTGGGT  GACAGAACCA  GGTATTTCAG  TATGTGGAAC  CAGGCGGTGG  ACAGCTACGA
19441  CCCCGATGTG  CGCATTATTG  AAAATCACGG  TGTGGAGGAT  GAACTACCCA  ACTATTGCTT
19501  CCCTTTGAAT  GGTGTGGGCT  TTACAGATAC  ATTCCAGGGA  ATTAAGGTTA  AAACTACCAA
19561  TAACGGAACA  GCAAATGCTA  CAGAGTGGGA  ATCTGATACC  TCTGTCAATA  ATGCTAATGA
19621  GATTGCCAAG  GGCAATCCTT  TCGCCATGGA  GATCAACATC  CAGGCCAACC  TGTGGCGGAA
19681  CTTCCTCTAC  GCGAACGTGG  CGCTGTACCT  GCCCGACTCC  TACAAGTACA  CGCCGGCCAA
19741  CATCACGCTG  CCCGCCAACA  CCAACACCTA  CGATTACATG  AACGGCCGCG  TGGTAGCGCC
19801  CTCGCTGGTG  GACGCCTACA  TCAACATCGG  GGCGCGCTGG  TCGCTGGACC  CCATGGACAA
19861  CGTCAACCCC  TTCAACCACC  ACCGCAACGC  GGGCCTGCGC  TACCGCTCCA  TGCTCCTGGG
19921  CAACGGGCGC  TACGTGCCCT  TCCACATCCA  GGTGCCCCAA  AAGTTTTTCG  CCATCAAGAG
19981  CCTCCTGCTC  CTGCCCGGGT  CCTACACCTA  CGAGTGGAAC  TTCCGCAAGG  ACGTCAACAT
20041  GATCCTGCAG  AGCTCCCTCG  GCAACGACCT  GCGCACGGAC  GGGGCCTCCA  TCGCCTTCAC
20101  CAGCATCAAC  CTCTACGCCA  CCTTCTTCCC  CATGGCGCAC  AACACCGCCT  CCACGCTCGA
20161  GGCCATGCTG  CGCAACGACA  CCAACGACCA  GTCCTTCAAC  GACTACCTCT  CGGCGGCCAA
20221  CATGCTCTAC  CCCATCCCGG  CCAACGCCAC  CAACGTGCCC  ATCTCCATCC  CTCGCGCAA
20281  CTGGGCCGCC  TTCCGCGGCT  GGTCCTTCAC  GCGCCTCAAG  ACCCGCGAGA  CGCCCTCGCT
20341  CGGCTCCGGG  TTCGACCCCT  ACTTCGTCTA  CTCGGGCTCC  ATCCCCTACC  TCGACGGCAC
20401  CTTCTACCTC  AACCACACCT  TCAAGAAGGT  CTCCATCACC  TTCGACTCCT  CCGTCAGCTG
20461  GCCCGGCAAC  GACCGCCTCC  TGACGCCCAA  CGAGTTCGAA  ATCAAGCGCA  CCGTCGACGG
```

FIG. 6F

```
20521  AGAGGGGTAC AACGTGGCCC AGTGCAACAT GACCAAGGAC TGGTTCCTGG TTCAGATGCT
20581  GGCCCACTAC AACATCGGCT ACCAGGGCTT CTACGTGCCC GAGGGCTACA AGGACCGCAT
20641  GTACTCCTTC TTCCGCAACT TCCAGCCCAT GAGCCGCCAG GTCGTGGACG AGGTCAACTA
20701  CAAGGACTAC CAGGCCGTCA CCCTGGCCTA CCAGCACAAC AACTCGGGCT TCGTCGGCTA
20761  CCTCGCGCCC ACCATGCGCC AGGGACAGCC CTACCCCGCC AACTACCCCT ACCCGCTCAT
20821  CGGCAAGAGC GCCGTCGCCA GCGTCACCCA GAAAAAGTTC CTCTGCGACC GGGTCATGTG
20881  GCGCATCCCC TTCTCCAGCA ACTTCATGTC CATGGGCGCG CTCACCGACC TCGGCCAGAA
20941  CATGCTCTAC GCCAACTCCG CCCACGCGCT AGACATGAAT TTCGAAGTCG ACCCCATGGA
21001  TGAGTCCACC CTTTCTCTATG TTGTCTTCGA AGTCTTCGAC GTCGTCCGAG TGCACCAGCC
21061  CCACCGCGGC GTCATCGAGG CCGTCTACCT GCGCACGCCC TTCTCGGCCG GTAACGCCAC
21121  CACCTAAGCC CCGCTCTTGC TTCTTGCAAG ATGACGGCCT GTGCGGGCTC CGGCGAGCAG
21181  GAGCTCAGGG CCATCCTCCG CGACCTGGGC TGCGGGCCCT GCTTCCTGGG CACCTTCGAC
21241  AAGCGCTTCC GGGGATTCAT GGCCCCGCAC AAGCTGGCCT GCGCCATCGT CAACACGGCC
21301  GGCCGCGAGA CCGGGGGCGA GCACTGGCTG GCCTTCGCCT GGAACCCGCG CTCCCACACC
21361  TGCTACCTCT TCGACCCCTT CGGGTTCTCG AACGAGCGCC TCAAGCAGAT CTACCAGTTC
21421  GAGTACGAGG GCCTGCTGCG CCGCAGCGCC CTGGCCACCG AGGACCGCTG CGTCACCCTG
21481  GAAAAGTCCA CCCAGACCGT GCAGGGTCCG CGCTCGGCCG CCTGCGGGCT CTTCTGCTGC
21541  ATGTTCCTGC ACGCCTTCGT GCACTGGCCC GACCGCCCCA TGGACAAGAA CCCCACCATG
21601  AACTTGCTGA CGGGGGTGCC CAACGGCATG CTCCAGTCGC CCCAGGTGGA ACCCACCCTG
21661  CGCCGCAACC AGGAAGCGCT CTACCGCTTC CTCAACGCCC ACTCCGCCTA CTTTCGCTCC
21721  CACCGCGCGC GCATCGAGAA GGCCACCGCC TTCGACCGCA TGAATCAAGA CATGTAAACC
21781  GTGTGTGTAT GTGAATGCTT TATTCATAAT AAACAGCACA TGTTTATGCC ACCTTCTCTG
21841  AGGCTCTGAC TTTATTTAGA AATCGAAGGG GTTCTGCCGG CTCTCGGCAT GCCCCGCGGG
21901  CAGGGATACG TTGCGGAACT GGTACTTGGG CAGCCACTTG AACTCGGGGA TCAGCAGCTT
21961  GGGCACGGGG AGGTCGGGGA ACGAGTCGCT CCACAGCTTG CGCGTGAGTT GCAGGGCGCC
22021  CAGCAGGTCG GGCGCGGAGA TCTTGAAATC GCAGTTGGGA CCCGCGTTCT GCGCGCGAGA
22081  GTTGCGGTAC ACGGGGTTGC AGCACTGGAA CACCATCAGG GCCGGGTGCT TCACGCTCGC
22141  CAGCACCGTC GCGTCGGTGA TGCCCTCCAC GTCCAGATCC TCGGCGTTGG CCATCCCGAA
22201  GGGGGTCATC TTGCAGGTCT GCCGCCCCAT GCTGGGCACG CAGCCGGGCT TGTGGTTGCA
22261  ATCGCAGTGC AGGGGGATCA GCATCATCTG GCCTGCTCG GAGCTCATGC CCGGGTACAT
22321  GGCCTTCATG AAAGCCTCCA GCTGGCGGAA GGCCTGCTGC GCCTTGCCGC CCTCGGTGAA
22381  GAAGACCCCG CAGGACTTGC TAGAGAACTG GTTGGTGGCG CAGCCCGCGT CGTGCACGCA
22441  GCAGCGCGCG TCGTTGTTGG CCAGCTGCAC CACGCTGCGC CCCAGCGGT CTGGGTGAT
22501  CTTGGCCCGG TCGGGGTTCT CCTTCAGCGC GCGCTGTCCG TTCTCGCTCG CCACATCCAT
22561  CTCGATCGTG TGCTCCTTCT GGATCATCAC GGTCCCGTGC AGGCACCGCA GCTTGCTCTC
22621  GGCCTCGGTG CACCCGTGCA GCCACAGCGC GCAGCCGGTG CTCTCCCAGT TCTTGTGGGC
22681  GATCTGGGAG TGCGAGTGCA CGAAGCCCTG CAGGAAGCGG CCCATCATCG CGGTCAGGGT
22741  CTTGTTGCTG GTGAAGGTCA GCGGGATGCC GCGGTGCTCC TCGTTCACAT ACAGGTGGCA
22801  GATGCGGCGG TACACCTCGC CCTGCTCGGG CATCAGCTGG AAGGCGGACT TCAGGTCGCT
22861  CTCCACGCGG TACCGGTCCA TCAGCAGCGT CATGACTTCC ATGCCCTTCT CCCAGGCCGA
22921  AACGATCGGC AGGCTCAGGG GGTTCTTCAC CGTTGTCATC TTAGTCGCCG CCGCCGAGGT
22981  CAGGGGGTCG TTCTCGTCCA GGGTCTCAAA CACTCGCTTG CCGTCCTTCT CGATGATGCG
23041  CACGGGGGGG AAGCTGAAGC CCACGGCCGC CAGCTCCTCC TCGGCCTGCC TTTCGTCCTC
23101  GCTGTCCTGG CTGATGTCTT GCAAAGGCAC ATGCTTGGTC TTGCGGGGTT TCTTTTTGGG
23161  CGGCAGAGGC GGCGGCGGAG ACGTGCTGGG CGAGCGCGAG TTCTCGCTCA CCACGACTAT
23221  TTCTTCTTCT TGGCCGTCGT CCGAGACCAC GCGGCGGTAG GCATGCCTCT TCTGGGGCAG
23281  AGGCGGAGGC GACGGGCTCT CGCGGTTCGG CGGGCGGCTG GCAGAGCCCC TTCCGCGTTC
23341  GGGGGTGCGC TCCTGGCGGC GCTGCTCTGA CTGACTTCCT CCGCGGCCGG CCATTGTGTT
23401  CTCCTAGGGA GCAACAACAA GCATGGAGAC TCAGCCATCG TCGCCAACAT CGCCATCTGC
23461  CCCCGCCGCC GACGAGAACC AGCAGAATGA AGCTTAACC GCCCCGCCGC CCAGCCCCAC
23521  CTCCGACGCC GCGGCCCAG ACATGCAAGA GATGGAGGAA TCCATCGAGA TTGACCTGGG
23581  CTACGTGACG CCCGCGGAGC ACGAGGAGGA GCTGGCAGCG CGCTTTTCAG CCCCGGAAGA
23641  GAACCACCAA GAGCAGCCAG AGCAGGAAGC AGAGAGCGAG CAGAACCAGG CTGGGCTCGA
23701  GCATGGCGAC TACCTGAGCG GGCAGAGGA CGTGCTCATC AAGCATCTGA CCCGCCAATG
23761  CATCATCGTC AAGGACGCGC TGCTCGACCG CGCCGAGGTG CCCCTCAGCG TGGCGGAGCT
23821  CAGCCGCGCC TACGAGCGCA ACCTCTTCTC GCCGCGCGTG CCCCCAAGC GCCAGCCCAA
23881  CGGCACCTGC GAGCCCAACC CGCGCCTCAA CTTCTACCCG GTCTTCGCGG TGCCCGAGGC
```

FIG. 6G

```
23941  CCTGGCCACC TACCACCTCT TTTTCAAGAA CCAAAGGATC CCCGTCTCCT GCCGCGCCAA
24001  CCGCACCCGC GCCGACGCCC TGCTCAACCT GGGCCCCGGC GCCCGCCTAC CTGATATCAC
24061  CTCCTTGGAA GAGGTTCCCA AGATCTTCGA GGGTCTGGGC AGCGACGAGA CTCGGGCCGC
24121  GAACGCTCTG CAAGGAAGCG GAGAGGAACA TGAGCACCAC AGCGCCCTGG TGGAGTTGGA
24181  AGGCGACAAC GCGCGCCTGG CGGTGCTCAA GCGCACGGTC GAGCTGACCC ACTTCGCCTA
24241  CCCGGCGCTC AACCTGCCCC CCAAGGTCAT GAGCGCCGTC ATGGACCAGG TGCTCATCAA
24301  GCGCGCCTCG CCCATTGAGG ACATGCAGGA CCCCGAGAGC TCGGACGAGG GCAAGCCCGT
24361  GGTCAGCGAC GAGCAGCTGG CGCGCTGGCT GGGAGCGAGT AGCACCCCCC AGAGCCTGGA
24421  AGAGCGGCGC AAGCTCATGA TGGCCGTGGT CCTGGTGACC GTGGAGCTGG AGTGTCTGCG
24481  CCGCTTCTTC GCCGACGCAG AGACCCTGCG CAAGGTCGAG GAGAACCTGC ACTACCTCTT
24541  CAGGCACGGG TTCGTGCGCC AGGCCTGCAA GATCTCCAAC GTGGAGCTGA CCAACCTGGT
24601  CTCCTACATG GGCATCCTGC ACGAGAACCG CCTGGGGCAG AACGTGCTGC ACACCACCCT
24661  GCGCGGGGAG GCCCGCCGCG ACTACATCCG CGACTGCGTC TACCTGTACC TCTGCCACAC
24721  CTGGCAGACG GGCATGGGCG TGTGGCAGCA GTGCCTGGAG GAGCAGAACC TGAAAGAGCT
24781  CTGCAAGCTC CTGCAGAAGA ACCTCAAGGC CCTGTGGACC GGGTTCGACG AGCGCACCAC
24841  CGCCTCGGAC CTGGCCGACC TCATCTTCCC CGAGCGCCTG CGGCTGACGC TGCGCAACGG
24901  GCTGCCCGAC TTTATGAGCC AAAGCATGTT GCAAAACTTT CGCTCTTTCA TCCTCGAACG
24961  CTCCGGGATC CTGCCCGCCA CCTGCTCCGC GCTGCCCTCG GACTTCGTGC CGCTGACCTT
25021  CCGCGAGTGC CCCCCGCCGC TCTGGAGCCA CTGCTACTTG CTGCGCCTGG CCAACTACCT
25081  GGCCTACCAC TCGGACGTGA TCGAGGACGT CAGCGGCGAG GGTCTGCTGG AGTGCCACTG
25141  CCGCTGCAAC CTCTGCACGC CGCACCGCTC CCTGGCCTGC AACCCCCAGC TGCTGAGCGA
25201  GACCCAGATC ATCGGCACCT TCGAGTTGCA AGGCCCCGGC GAGGAGGGCA AGGGGGGTCT
25261  GAAACTCACC CCGGGGCTGT GGACCTCGGC CTACTTGCGC AAGTTCGTGC CGGAGGACTA
25321  CCATCCCTTC GAGATCAGGT TCTACGAGGA CCAATCCCAG CCGCCCAAGG CCGAGCTGTC
25381  GGCCTGCGTC ATCACCCAGG GGGCCATCCT GGCCCAATTG CAAGCCATCC AGAAATCCCG
25441  CCAAGAATTT CTGCTGAAAA AGGGCCACGG GGTCTACTTG GACCCCAGA CCGGAGAGGA
25501  GCTCAACCCC AGCTTCCCCC AGGATGCCCC GAGGAAGCAG CAAGAAGCTG AAAGTGGAGC
25561  TGCCGCCGCC GGAGGATTTG GAGGAAGACT GGGAGAGCAG TCAGGCAGAG GAGGAGATGG
25621  AAGACTGGGA CAGCACTCAG GCAGAGGAGG ACAGCCTGCA AGACAGTCTG GAGGAGGAAG
25681  ACGAGGTGGA GGAGGAGGAG GCAGAGGAAG AAGCAGCCGC CGCCAGACCG TCGTCCTCGG
25741  CGGAGAAAGC AAGCAGCACG GATACCATCT CCGCTCCGGG TCGGGGTCGC GGCGGCCGGG
25801  CCCACAGTAG GTGGGACGAG ACCGGGCGCT TCCCGAACCC CACCACCCAG ACCGGTAAGA
25861  AGGAGCGGCA GGGATACAAG TCCTGGCGGG GGCACAAAAA CGCCATCGTC TCCTGCTTGC
25921  AAGCCTGCGG GGGCAACATC TCCTTCACCC GGCGCTACCT GCTCTTCCAC CGCGGGGTGA
25981  ACTTCCCCCG CAACATCTTG CATTACTACC GTCACCTCCA CAGCCCCTAC TACTGTTTCC
26041  AAGAAGAGGC AGAAACCCAG CAGCAGCAGA AAACCAGCGA CAGCGGCAGC AGCTAGAAAA
26101  TCCACAGCGG CAGGTGGACT GAGGATCGCG GCGAACGAGC CGGCGCAGAC CGGGAGCTG
26161  AGGAACCGGA TCTTTCCCAC CCTCTATGCC ATCTTCCAGC AGAGTCGGGG GCAGGAGCAG
26221  GAACTGAAAG TCAAGAACCG TTCTCTGCGC TCGCTCACCC GCAGTTGTCT GTATCACAAG
26281  AGCGAAGACC AACTTCAGCG CACTCTCGAG GACGCCGAGG CTCTCTTCAA CAAGTACTGC
26341  GCGCTCACTC TTAAAGAGTA GCCCGCGCCC GCCCACACAC GGAAAAAGGC GGGAATTACG
26401  TCACCACCTG CGCCCTTCGC CCGACCATCA TCATGAGCAA AGAGATTCCC ACGCCTTACA
26461  TGTGGAGCTA CCAGCCCCAG ATGGGTCTGG CCGCCGGCGC CGCCCAGGAC TACTCCACCC
26521  GCATGAACTG GCTCAGTGCC GGGCCCGCGA TGATCTCACG GGTGAATGAC ATCCGCGCCC
26581  ATCGAAACCA GATACTCCTA GAACAGTCAG CGATCACCGC CACGCCCCGC CATCACCTTA
26641  ATCCGCGTAA TTGGCCCGCC GCCCTGGTGT ACCAGGAAAT TCCCCAGCCC ACGACCGTAC
26701  TACTTCCGCG AGACGCCCAG GCCGAAGTCC AGCTGACTAA CTCAGGTGTC CAGCTGGCCG
26761  GCGGCGCCGC CCTGTGTCGT CACCGCCCCG CTCAGGGTAT AAAGCGGCTG GTGATCCGAG
26821  GCAGAGGCAC ACAGCTCAAC GACGAGGTGG TGAGCTCTTC GCTGGGTCTG CGACCTGACG
26881  GAGTCTTCCA ACTCGCCGGA TCGGGGAGAT CTTCCTTCAC GCCTCGTCAG GCCGTCCTGA
26941  CTTTGGAGAG TTCGTCCTCG CAGCCCGCT CGGGCGGCAT CGGCACTCTC CAGTTCGTGG
27001  AGGAGTTCAC TCCCTCGGTC TACTTCAACC CCTTCTCCGG CTCCCCCGGC CACTACCCGG
27061  ACGAGTTCAT CCCGAACTTC GACGCCATCA GCGAGTCGGT GGACGGCTAC GATTGAATGT
27121  CCCATGGTGG CGCAGCTGAC CTAGCTCGGC TTCGACACCT GGACCACTGC CGCCGCTTCC
27181  GCTGCTTCGC TCGGGATCTC GCCGAGTTTG CCTACTTTGA GCTGCCCGAG GAGCACCCTC
27241  AGGGCCCGGC CCACGGAGTG CGGATCATCA TCGAAGGGGG CCTCGACTCC CACCTGCTTC
27301  GGATCTTCAG CCAGCGACCG ATCCTGGTCG AGCGCGAGCA AGGACAGACC CGTCTGACCC
```

FIG. 6H

```
27361  TGTACTGCAT CTGCAACCAC CCCGGCCTGC ATGAAAGTCT TGTTGTCTG  CTGTGTACTG
27421  AGTATAATAA AAGCTGAGAT CAGCGACTAC TCCGGACTCG ATTGTGGTGT TCCTGCTATC
27481  AACCGGTCCC TGTTCTTCAC CGGGAACGAG ACCGAGCTCC AGCTCCAGTG TAAGCCCCAC
27541  AAGAAGTACC TCACCTGGCT GTTCCAGGGC TCTCCGATCG CCGTTGTCAA CCACTGCGAC
27601  AACGACGGAG TCCTGCTGAG CGGCCCTGCC AACCTTACTT TTTCCACCCG CAGAAGCAAG
27661  CTCCAGCTCT TCCAACCCTT CCTCCCCGGG ACCTATCAGT GCGTCTCGGG ACCCTGCCAT
27721  CACACCTTCC ACCTGATCCC GAATACCACA GCGCCGCTCC CCGCTACTAA CAACCAAACT
27781  ACCCACCAAC GCCACCGTCG CGACCTTTCC TCTGAATCTA ATACTACCAC CCACACCGGA
27841  GGTGAGCTCC GAGGTCGACC AACCTCTGGG ATTTACTACG GCCCTGGGA  GGTGGTGGGG
27901  TTAATAGCGC TAGGCCTAGT TGTGGGTGGG CTTTTGGCTC TCTGCTACCT ATACCTCCCT
27961  TGCTGTTCGT ACTTAGTGGT GCTGTGTTGC TGGTTTAAGA AATGGGGAAG ATCACCCTAG
28021  TGAGCTGCGG TGTGCTGGTG GCGGTGTTGC TTTCGATTGT GGGACTGGGC GGCGCGGCTG
28081  TAGTGAAGGA GGAGAAGGCC GATCCCTGCT TGCATTTCAA TCCCGACAAA TGCCAGCTGA
28141  GTTTTCAGCC CGATGGCAAT CGGTGCACGG TGCTGATCAA GTGCGGATGG GAATGTGAGA
28201  ACGTGAGAAT CGAGTACAAT AACAAGACTC GGAACAATAC TCTCGCGTCC GTGTGGCAAC
28261  CCGGGGACCC CGAGTGGTAC ACCGTCTCTG TCCCCGGTGC TGACGGCTCC CCGCGCACCG
28321  TGAATAATAC TTTCATTTTT GCGCACATGT GCGACACGG  CATGTGGATG AGCAAGCAGT
28381  ACGATATGTG GCCCCCCACG AAGGAGAACA TCGTGGTCTT CTCCATCGCT TACAGCGTGT
28441  GCACGGCGCT AATCACCGCT ATCGTGTGCC TGAGCATTCA CATGCTCATC GCTATTCGCC
28501  CCAGAAATAA TGCCGAAAAA GAGAAACAGC CATAACACGT TTTTTCACAC ACCTTTTTCA
28561  GACCATGGCC TCTGTTACTG CCCTAATTAT TTTTTTGGGT CTCGTGGGCA CTAGCAGCAC
28621  TTTTCAGCAT ATAAACAAAA CTGTTTATGC TGGTTCTAAT TCTGTATTAC CTGGGCATCA
28681  ATCACACCAG AAAGTTTCAT GGTACTGGTA TGATAAAAAT AACACGCCAG TCACACTCTG
28741  CAAGGGTCAT CAAACACCCA TAAACCGTAG TGGAATTTTT TTAAATGTA  ATCATAATAA
28801  TATTACACTA CTTTCAATTA CAAAGCACTA TTCTGGTACT TACTATGGAA CCAATTTTAA
28861  CATAAAACAG GACACTTACT ATAGTGTCAC AGTATTGGAT CCAACTACTC CTAGAACAAC
28921  TACAAAACCC ACAACTACTA AGAGGCACAC TAAACCTAAA ACTACCAAGA AAACCACTGT
28981  CAAAACAACA ACTAGGACCA CCACAACTAC AGAGGCTACC ACCAGCACAA CACTTGCTGC
29041  AACTACACAC ACACACACTG AGCTAACCTT ACAGACCACT AATGATTTGA TAGCCCTGTT
29101  GCAAAGGGG  GATAACAGCA CCACTTCCGA TGAGGAAATA CCCAAATCCA TGATTGGCAT
29161  TATTGTTGCT GTAGTGGTGT GCATGTTGAT CATCGCCTTG TGCATGGTGT ACTATGCCTT
29221  CTGCTACAGA AAGCACAGAC TGAACGACAA GCTGGAACAC TTACTAAGTG TTGAATTTTA
29281  ATTTTTTAGA ACCATGAAGA TCCTAGGCCT TTTAGTTTTT TCTATCATTA CCTCTGCTCT
29341  TTGTGAATCA GTGAATAAAG ATGTTACTAT TACCACTGGT TCTAATTATA CACTGAAAGG
29401  GCCACCCTCA GGTATGCTTT CGTGGTATTG CTATTTTGGA ACTGACACTG ATCAAACTGA
29461  ATTATGCAAT TTTCAAAAAG GCAAAACCTC AAACTCTAAA ATCTCTAATT ATCAATGCAA
29521  TGGCACTGAT CTGATACTAC TCAATGTCAC GAAAGCATAT GGTGGCAGTT ATTCTTGCCC
29581  TGGACAAAAC ACTGAAGAAA TGATTTTTTA CAAAGTGGAA GTGGTTGATC CCACTACTCC
29641  ACCCACCACC ACAACTACTC ACACCACACA CACAGAACAA ACCACAGCAG AGGAGGCAGC
29701  AAAGTTAGCC TTGCAGGTCC AAGACAGTTC ATTTGTTGGC ATTACCCCTA CACCTGATCA
29761  GCGGTGTCCG GGCTGCTAG  TCAGCGGCAT TGTCGGTGTG CTTTCGGGAT TAGCAGTCAT
29821  AATCATCTGC ATGTTCATTT TGCTTGCTG  CTATAGAAGG CTTTACCGAC AAAAATCAGA
29881  CCCACTGCTG AACCTCTATG TTTAATTTTT TCCAGAGCCA TGAAGGCAGT TAGCACTCTA
29941  GTTTTTTGTT CTTTGATTGG CATTGTTTTT AGTGCTGGGT TTTTGAAAAA TCTTACCATT
30001  TATGAAGGTG AGAATGCCAC TCTAGTGGGC ATCAGTGGTC AAAATGTCAG CTGGCTAAAA
30061  TACCATCTAG ATGGGTGGAA AGACATTTGC GATTGGAATG TCACTGTGTA TACATGTAAT
30121  GGAGTTAACC TCACCATTAC TAATGCCACC CAAGATCAGA TGGTAGGTT  TAAGGGTCAG
30181  AGTTTCACTA GAAATAATGG GTATGAATCC CATAACATGT TTATCTATGA CGTCACTGTC
30241  ATCAGAAATG AGACCGCCAC CACCACACAG ATGCCCACTA CACACAGTTC TACCACTACT
30301  ACCAAGCAAA CCACACAGAC AACCACTTTT TATACATCAA CTCAGCATAT GACCACCACT
30361  ACAGCAGCAA AGCCAAGTAG CGCAGCGCCT CAGCCACAGG CTTTGGCTTT GAAAGCTGCA
30421  CAACCTAGTA CAACTACTAA GACCAATGAG CAGACTACTG ATTTTTGTC  CACTGTCGAG
30481  AGCCACACCA CAGCTACCTC CAGTGCCTTC TCTAGCACCG CCAATCTCTC CTCGCTTTCC
30541  TCTACACCAA TCAGTCCCGC TACTACTCCT AGCCCCGCTC CTCTTCCCAC TCCCCTGAAG
30601  CAAACAGACG GCGGCATGCA ATGGCAGATC ACCCTGCTCA TTGTGATCGG GTTGGTCATC
30661  CTGGCCGTGT TGCTCTACTA CATCTTCTGC CGCCGCATTC CAACGCGCA  CCGCAAGCCG
30721  GTCTACAAGC CCATCGTTGT CGGGCAGCCG GAGCCGCTTC AGGTGGAAGG GGGTCTAAGG
```

FIG. 61

```
30781  AATCTTCTCT TCTCTTTTAC AGTATGGTGA TTGAACTATG ATTCCTAGAC AATTCTTGAT
30841  CACTATTCTT ATCTGCCTCC TCCAAGTCTG TGCCACCCTC GCTCTGGTGG CCAACGCCAG
30901  TCCAGACTGT ATTGGGCCCT TCGCCTCCTA CGTGCTCTTT GCCTTCATCA CCTGCATCTG
30961  CTGTTGTAGC ATAGTCTGCC TGCTTATCAC CTTCTTCCAG TTCATTGACT GGATCTTTGT
31021  GCGCATCGCC TACCTGCGCC ACCACCCCCA GTACCGCGAC CAGCGAGTGG CGCGACTGCT
31081  CAGGCTCCTC TGATAAGCAT GCGGGCTCTG CTACTTCTCG CGCTTCTGCT GTTAGTGCTC
31141  CCCCGTCCCG TCGACCCCCG GTCCCCCGAG GAGGTCCGCA AATGCAAATT CCAAGAACCC
31201  TGGAAATTCC TCAAATGCTA CCGCCAAAAA TCAGACATGC ATCCCAGCTG GATCATGATC
31261  ATTGGGATCG TGAACATTCT GGCCTGCACC CTCATCTCCT TTGTGATTTA CCCCTGCTTT
31321  GACTTTGGTT GGAACTCGCC AGAGGCACTC TATCTCCCGC TGAGCCTGA CACACCACCA
31381  CAGCAGCAAC CTCAGGCACA CGCACTACCA CCACCACAGC CTAGGCCACA ATACATGCCC
31441  ATATTAGACT ATGAGGCCGA GCCACAGCGA CCCATGCTCC CCGCTATTAG TTACTTCAAT
31501  CTAACCGGCG GAGATGACTG ACCCACTGGC CAACAACAAC GTCAACGACC TTCTCCTGGA
31561  CATGGACGGC CGCGCCTCGG AGCAGCGACT CGCCCAACTC CGCATCCGCC AGCAGCAGGA
31621  GAGAGCCGTC AAGGAGCTGC AGGATGCGGT GGCCATCCAC CAGTGCAAGA AGGCATCTT
31681  CTGCCTGGTG AAGCAGGCCA AGATCCTA CGAGGTCACC CAGACCGACC ATCGCCTCTC
31741  CTACGAGCTC CTGCAGCAGC GCCAGAAGTT CACCTGCCTG GTCGGAGTCA ACCCCATCGT
31801  CATCACCCAG CAGTCGGGCG ATACCAAGGG GTGCATCCAC TGCTCCTGCG ACTCCCCCGA
31861  GTGCGTTCAC ACCATGATCA AGACCCTCTG CGGCCTCCGC GACCTCCTCC CCATGAACTA
31921  ATCACCCCCT TATCCAGTGA AATAAAGATC ATATTGATGA TGATTTAAAT AAAAAAATAA
31981  TCATTTGATT TGAAATAAAG ATACAATCAT ATTGATGATT TGAGTTTAAC AAAAATAAAG
32041  AATCACTTAC TTGAAATCTG ATACCAGGTC TCTGTCCATG TTTTCTGCCA ACACCACCTC
32101  ACTCCCCTCT TCCCAGCTCT GGTACTGCAG GCCCCGGCGG GCTGCAAACT TCCTCCACAC
32161  GCTGAAGGGG ATGTCAAATT CCTCCTGTCC CTCAATCTTC ATTTTCTCTT CTATCAGATG
32221  TCCAAAAAGC GCGCGCGGGT GGATGATGAC TTCGACCCCG TGTACCCCTA CGATGCAGAC
32281  AACGCACCGA CTGTGCCCTT CATCAACCCT CCCTTCGTCT CTTCAGATGG ATTCCAAGAA
32341  AAGCCCCTGG GGGTGTTGTC_CCTGCGACTG GCCGATCCCG TCACCACCAA GAACGGGGCT
32401  GTCACCCTCA AGCTGGGGGA GGGGGTGGAC CTCGACGACT CGGGAAAACT CATCTCCAAA
32461  AATGCCACCA AGGCCACTGC CCCTCTCAGT ATTTCCAACA ACACCATTTC CCTTAACATG
32521  GATACCCCTC_TTTACAACAA CAATGGAAAG CTAGGTATGA AGGTAACCGC ACCATTAAAG
32581  ATATTAGACA CAGATCTACT AAAAACACTT GTTGTTGCTT ATGGGCAGGG ATTAGGAACA
32641  AACACCAATG GTGCTCTTGT TGCCCAACTA GCATACCCAC TTGTTTTTAA TACCGCTAGC
32701  AAAATTGCCC TTAATTTAGG CAATGGACCA TTAAAAGTGG ATGCAAATAG ACTGAACATT
32761  AATTGCAAAA GAGGTATCTA TGTCACTACC ACAAAAGATG CACTGGAGAT TAATATCAGT
32821  TGGGCAAATG CTATGACATT TATAGGAAAT GCCATTGGTG TCAATATTGA CACAAAAAAA
32881  GGCCTACAGT TCGGCACTTC AAGCACTGAA ACAGATGTTA AAAATGCTTT TCCACTCCAA
32941  GTAAAACTTG GAGCTGGTCT TACATTTGAC AGCACAGGTG CCATTGTTGC TTGGAACAAA
33001  GAAGATGACA AACTTACACT GTGGACCACA GCCGATCCAT CTCCAAACTG TCACATATAT
33061  TCTGCAAAGG ATGCTAAGCT TACACTCTGC TTGACAAAGT GTGGTAGTCA GATACTGGGC
33121  ACTGTTTCTC TCATAGCTGT TGATACTGGT AGCTTAAATC CAATAACAGG AAAAGTAACC
33181  ACTGCTCTTG TTTCACTTAA ATTCGATGCC AATGGAGTTT TGCAAGCCAG TTCAACACTA
33241  GATAAAGAAT ATTGGAATTT CAGAAAAGGA GATGTGACAC CTGCTGACCC CTACACTAAT
33301  GCTATAGGCT TTATGCCCAA CCTTAATGCA TACCCAAAAA ACACAAACGC AGCTGCAAAA
33361  AGTCACATTG TTGGAAAAGT ATACCTACAT GGGGATGAAA GCAAGCCACT AGACTTGATA
33421  ATTACATTTA ATGAAACCAG TGATGAATCC TGTACTTATT GCATTAACTT TCAGTGGCAG
33481  TGGGGAACTG ACCAATATAA AGATGAAACA CTTGCAGTCA GTTCATTCAC CTTCTCATAC
33541  ATTGCTAAAG AATAACATCC ACCCTGCATG CCAACCCATT TCCCTCTATC TATACATGGA
33601  AAACTCTGAA GCAGAAAAAA TAAAGTTCAA GTGTTTATT GATTCAACAG TTTTTACAGA
33661  ATTCGAGTAG TTATTTTCCC TCCACCCTCC CAACTCATGG AATACACCAT CCTCTCCCCA
33721  CGCACAGCCT TAAACATCTG AATGCCATTG GTAATGGACA TGGTTTTGGC CTCCACATTC
33781  CACACAGTTT CAGAGCGAGC CAGTCTCGGG TCGGTCAGGG AGATGAAACC CTCCGGGCAC
33841  TCCTGCATCT GCACCTCACA GTTCAACAGC TGAGGCTGT CCTCGGTGGT CGGGATCACA
33901  GTTATCTGGA AGAAGAGCGA TGAGAGTCAT AATCCGCGAA CGGGATCGGG CGGTTGTGGC
33961  GCATCAGGCC CCGCAGCAGT CGCTGTCTGC GCCGCTCCGT CAAGCTGCTG CTCAAGGGGT
34021  CCGGGTCCAG GGACTCCCCG CGCATGATGC CGATGGCCCT GAGCATCAGT CGCCTGGTGC
34081  GGCGGGCGCA GCAGCGGATG CGGATCTCAC TCAGGTCGGA ACAGTACGTG CAGCACAGCA
34141  CTACCAAGTT GTTCAACAGT CCATAGTTCA ACGTGCTCCA GCCAAAACTC ATCTGTGGAA
```

FIG. 6J

```
34201  CTATGCTGCC CACATGTCCA TCGTACCAGA TCCTGATGTA AATCAGGTGG CGCCCCCTCC
34261  AGAACACACT GCCCATGTAC ATGATCTCCT TGGGCATGTG CAGGTTCACC ACCTCCCGGT
34321  ACCACATCAC CCGCTGGTTG AACATGCAGC CCCGGATGAT CCTGCGGAAC CACAGGGCCA
34381  GCACCGCCCC GCCCGCCATG CAGCGCAGGG ACCCCGGGTC CTGGCAATGG CAGTGGATGA
34441  TCCACCGCTC GTACCCGTGG ATCATCTGGG AGCTGAACAA GTCTATGTTG GCACAGCACA
34501  GGCACACGCT CATGCATCTC TTCAGCACTC TCAGCTCCTC GGGGGTCAAA ACCATATCCC
34561  AGGGTACGGG GAACTCTTGC AGGACAGCGA ACCCCGCAGA ACAGGGCAAA CCTCGCACAG
34621  AACTTACATT GTGCATGGAC AGGGTATCGC AATCAGGCAG CACCGGGTGA TCCTCCACCA
34681  GGGAAGCGCG GGTCTCGATT TCCTCACAGC GTGGTAAGGG GGCCGGTCGA TACGGGTGAT
34741  GGCGGGACGC GGCTGATCGT GTTCGCGATC GTGTCATGAT GCAGTTGCTT TCGGACATTT
34801  TCGTACTTGC TATAGCAGAA CCTGGTCCGG GCGCTGCACA CCGATCGCCG GCGGCGGTCT
34861  CGGCGCTTGG AACGCTCCGT GTTGAAATTG TAAAACAGCC ACTCTCTCAG ACCGTGCAGC
34921  AGATCTAGGG CCTCAGGAGT GATGAAGATC CCATCATGCC TGATGGCTCT GATCACATCG
34981  ACCACCGTGG AATGGGCCAG ACCCAGCCAG ATGATGCAAT TTTGTTGGGT TTCGGTGACG
35041  GCGGGGGAGG GAAGAACAGG AAGAACCATG ATTAACTTTA ATCCAAACGG TCTCGGAGCA
35101  CTTCAAAATG AAGGTCGCGG AGATGGCACC TCTCGCCCCC GCTGTGTTGG TGGAAAATAA
35161  CAGCCAGGTC AAAGGTGATA CGGTTCTCGA GATGTTCCAC GGTGGCTTCC AGCAAAGCCT
35221  CCACGCGCAC ATCCAGAAAC AAGACAATAG CGAAAGCGGG AGGGTTCTCT AATTCCTCAA
35281  TCATCATGTT ACACTCCTGC ACCATCCCCA GATAATTTTC ATTTTCCAG CCTTGAATGA
35341  TTCGAACTAG TTCCTGAGGT AAATCCAAGC CAGCCATGAT AAAGAGCTCG CGCAGAGCGC
35401  CCTCCACCGG CATTCTTAAG CACACCCTCA TAATTCCAAG ATATTCTGCT CCTGGTTCAC
35461  CTGCAGCAGA TTGACAAGCG GAATATCAAA CTCTCTGCCG CGATCCCTAA GCTCCTCCCT
35521  CAGCAATAAC TGTAAGTACT CTCTCATATC CTCTCCGAAA TTTTTAGCCA TAGGACCGCC
35581  AGGAATAAGA TTAGGGCAAG CCACAGTACA GATAAACCGA AGTCCTCCCC AGTGAGCATT
35641  GCCAAATGCA AGACTGCTAT AAGCATGCTG GCTAGACCCG GTGATATCTT CCAGATAATT
35701  GGACAGAAAA TCGCCCAGGC AATTTTTAAG AAAATCAACA AAGAAAAAT CCTCCAGGTG
35761  CACGTTTAGA GCCTCGGGAA CAACGATGGA GTAAATGCAA GCGGTGCGTT CCAGCATGGT
35821  TAGTTAGCTG ATCTGTAGAA AAAACAAAAA TGAACATTAA ACCATGCTAG CCTGGCGAAC
35881  AGGTGGGTAA ATCGTTCTTT CCAGCACCAG GCAGGCCACG GGTCTCCGG CGCGACCCTC
35941  GTAAAAATTG TCGCTATGAT TGAAAACCAT CACAGAGAGA CGTTCCCGGT GGCCGGCGTG
36001  AATGATTCGA CAAGACGAAT ACACCCCGG AACATTGGCG TCCGCGAGTG AAAAAAAGCG
36061  CCCGAGGAAG CAATAAGGCA CTACAATGCT CAGTCTCAAG TCCAGCAAAG CGATGCCATG
36121  CGGATGAAGC ACAAAATTCT CAGGTGCGTA CAAAATGTAA TTACTCCCCT CCTGCACAGG
36181  CAGCAAAGCC CCCGATCCCT CCAGGTACAC ATACAAAGCC TCAGCGTCCA TAGCTTACCG
36241  AGCAGCAGCG GCACACAACA GGCGCAAAAG TCAGAGAAAG GCTGAGAGCT CTAACCTGTC
36301  CACCCGCTCT CTGCTCAATA TATAGCCCAG ATCTACACTG ACGTAAAGGC CAAAGTCTAA
36361  AAATACCCGC CAAATAATCA CACACGCCCA GCACACGCCC AGAAACCGGT GACACACTCA
36421  GAAAAATACG CGCACTTCCT CAAACGCCCA AACTGCCGTC ATTTCCGGGT TCCCACGCTA
36481  CGTCATCAAA ATTCAACTTT CAAATTCCGT CGACCGTTAA AAACGTCACC CGCCCCGCCC
36541  CTAACGGTCG CCGCTCCCGC AGCCAATCAG CGCCCCGCAT CCCCAAATTC AAACGGCTCA
36601  TTTGCATATT AACGCGCACC AAAAGTTTGA GGTATATTAT TGATGATG     (SEQ ID NO: 2)
```

FIG. 6K

```
   1 CATCATCAAT AATATACCTC AAACTTTTGG TGCGCGTTAA TATGCAAATG AGCTGTTTGA
  61 ATTTGGGGAG GGAGGAAGGT GATTGGCTGC GGGAGCGGCG ACCGTTAGGG GCGGGGCGGG
 121 TGACGTTTTG ATGACGTGGC TATGAGGCGG AGCCGGTTTG CAAGTTCTCG TGGGAAAAGT
 181 GACGTCAAAC GAGGTGTGGT TTGAACACGG AAATACTCAA TTTTCCCGCG CTCTCTGACA
 241 GGAAATGAGG TGTTTCTGGG CGGATGCAAG TGAAAACGGG CCATTTTCGC GCGAAAACTG
 301 AATGAGGAAG TGAAAATCTG AGTAATTTCG CGTTTATGGC AGGGAGGAGT ATTTGCCGAG
 361 GGCCGAGTAG ACTTTGACCG ATTACGTGGG GGTTTCGATT ACCGTATTTT TCACCTAAAT
 421 TTCCGCGTAC GGTGTCAAAG TCCGGTGTTT TTACGTAGGC GTCAGCTGAT CGCCAGGGTA
 481 TTTAAACCTG CGCTCTCTAG TCAAGAGGCC ACTCTTGAGT GCCAGCGAGT AGAGTTTTCT
 541 CCTCCGCGCC GCGAGTCAGA TCTACACTTT GAAAGATGAG GCACCTGAGA GACCTGCCCG
 601 GTAATGTTTT CCTGGCTACT GGGAACGAGA TTCTGGAATT GGTGGTGGAC GCCATGATGG
 661 GTGACGACCC TCCAGAGCCC CCTACCCCAT TTGAGGCGCC TTCGCTGTAC GATTTGTATG
 721 ATCTGGAGGT GGATGTGCCC GAGAGCGACC CTAACGAGGA GGCGGTGAAT GATTTGTTTA
 781 GCGATGCCGC GCTGCTGGCT GCCGAGCAGG CTAATACGGA CTCTGGCTCA GACGCAGATT
 841 CCTCTCTCCA TACCCCGAGA CCCGGCAGAG GTGAGAAAAA GATCCCCGAG CTTAAAGGGG
 901 AAGAGCTCGA CCTGCGCTGC TATGAGGAAT GCTTGCCTCC GAGCGATGAT GAGGAGGACG
 961 AGGAGGCGAT TCGAGCTGCG GTGAACCAGG GAGTGAAAAC TGCGGGCGAG AGCTTTAGCC
1021 TGGACTGTCC TACTCTGCCC GGACACGGCT GTAAGTCTTG TGAATTTCAT CGCATGAATA
1081 CTGGAGATAA GAATGTGATG TGTGCCCTGT GCTATATGAG AGCTTACAAC CATTGTGTTT
1141 ACAGTAAGTG TGATTAACTT TAGTTGGGAA GGCAGAGGGT GACTGGGTGC TGACTGGTTT
1201 ATTTATGTAT ATGTTTTTTT ATGTGTAGGT CCCGTCTCTG ACGTAGATGA GACCCCCACT
1261 TCAGAGTGCA TTTCATCACC CCCAGAAATT GGCGAGGAAC CGCCCGAAGA TATTATTCAT
1321 AGACCAGTTG CAGTGAGAGT CACCGGGCGG AGAGCAGCTG TGGAGAGTTT GGATGACTTG
1381 CTACAGGGTG GGGATGAACC TTTGGACTTG TGTACCCGGA AACGCCCCAG GCACTAAGTG
1441 CCACACATGT GTGTTTACTT AAGGTGATGT CAGTATTTAT AGGGTGTGGA GTGCAATAAA
1501 ATCCGTGTTG ACTTTAAGTG CGTGTTTTAT GACTCAGGGG TGGGGACTGT GGGTATATAA
1561 GCAGGTGCAG ACCTGTGTGG TCAGTTCAGA GCAGGACTCA TGGAGATCTG GACTGTCTTG
1621 GAAGACTTTC ACCAGACTAG ACAGTTGCTA GAGAACTCAT CGGAGGAGT CTCTTACCTG
1681 TGGAGATTCT GCTTCGGTGG GCCTCTAGCT AAGCTAGTCT ATAGGGCCAA ACAGGATTAT
1741 AAGGAACAAT TTGAGGATAT TTTGAGAGAG TGTCCTGGTA TTTTTGACTC TCTCAACTTG
1801 GGCCATCAGT CTCACTTTAA CCAGAGTATT CTGAGAGCCC TTGACTTTTC TACTCCTGGC
1861 AGAACTACCG CCGCGGTAGC CTTTTTTGCC TTTATTCTTG ACAAATGGAG TCAAGAAACC
1921 CATTTCAGCA GGGATTACCG TCTGGACTGC TTAGCAGTAG CTTTGTGGAG AACATGGAGG
1981 TGCCAGCGCC TGAATGCAAT CTCCGGCTAC TTGCCAGTAC AGCCGGTAGA CACGCTGAGG
2041 ATCCTGAGTC TCCAGTCACC CCAGGAACAC CAACGCCGCC AGCAGCCGCA GCAGGAGCAG
2101 CAGCAAGAGG AGGACCGAGA AGAGAACCCG AGAGCCGGTC TGGACCCTCC GGTGGCGGAG
2161 GAGGAGGAGT AGCTGACTTG TTTCCCGAGC TGCGCCGGGT GCTGACTAGG TCTTCCAGTG
2221 GACGGGAGAG GGGGATTAAG CGGGAGAGCC ATGAGGAGAC TAGCCACAGA ACTGAACTGA
2281 CTGTCAGTCT GATGAGCCGC AGGCGCCCAG AATCGGTGTG GTGGCATGAG GTGCAGTCGC
2341 AGGGGATAGA TGAGGTCTCG GTGATGCATG AGAAATATTC CCTAGAACAA GTCAAGACTT
2401 GTTGGTTGGA GCCCGAGGAT GATTGGGAGG TAGCCATCAG GAATTATGCC AAGCTGGCTC
2461 TGAAGCCAGA CAAGAAGTAC AAGATTACCA AACTGATTAA TATCAGAAAT CCTGCTACA
2521 TTTCAGGGAA TGGGGCCGAG GTGGAGATCA GTACCCAGGA GAGGGTGGCC TTCAGATGTT
2581 GTATGATGAA TATGTACCCG GGGGTGGTGG GCATGGAGGG AGTCACCTTT ATGAACACGA
2641 GGTTCAGGGG TGATGGGTAT AATGGGGTGG TCTTTATGGC CAACACCAAG CTGACAGTGC
2701 ACGGATGCTC CTTCTTTGGC TTCAATAACA TGTGCATCGA GGCCTGGGGC AGTGTTTCAG
2761 TGAGGGGATG CAGCTTTTCA GCCAACTGGA TGGGGGTCGT GGGCAGAACC AAGAGCAAGG
2821 TGTCAGTGAA GAAATGCCTG TTCGAGAGGT GCCACCTGGG GGTGATGAGC GAGGGCGAAG
2881 CCAAAGTCAA ACACTGCGCC TCTACCGAGA CGGGCTGCTT TGTGCTGATC AAGGGCAATG
2941 CCCAAGTCAA GCATAACATG ATCTGTGGGG CCTCGGATGA GCGCGGCTAC CAGATGCTGA
3001 CCTGCGCCGG TGGGAACAGC CATATGCTGG CCACCGTGCA TGTGGCCTCG CACCCCCGCA
3061 AGACATGGCC CGAGTTCGAG CACAACGTCA TGACCCGCTG CAATGTGCAC CTGGGCTCCC
3121 GCCGAGGCAT GTTCATGCCC TACCAGTGCA ACATGCAATT TGTGAAGGTG CTGCTGGAGC
3181 CCGATGCCAT GTCCAGAGTG AGCCTGACGG GGGTGTTTGA CATGAATGTG GAGCTGTGGA
3241 AAATTCTGAG ATATGATGAA TCCAAGACCA GGTGCCGGGC CTGCGAATGC GGAGGCAAGC
3301 ACGCCAGGCT TCAGCCCGTG TGTGTGGAGG TGACGGAGGA CCTGCGACCC GATCATTTGG
3361 TGTTGTCCTG CAACGGGACG GAGTTCGGCT CCAGCGGGGA AGAATCTGAC TAGAGTGAGT
3421 AGTGTTTGGG GCTGGGTGTG AGCCTGCATG AGGGGCAGAA TGACTAAAAT CTGTGGTTTT
```

FIG. 7A

```
3481 CTGTGTGTTG CAGCAGCATG AGCGGAAGCG CCTCCTTTGA GGGAGGGGTA TTCAGCCCTT
3541 ATCTGACGGG GCGTCTCCCC TCCTGGGCGG GAGTGTGTCA GAATGTTATG GNATCCACGG
3601 TGGACGGCCG GCCCGTGCAG CCCGCGAACT CTTCAACCCT GACCTACGCG ACCCTGAGCT
3661 CCTCGTCCGT GGACGCAGCT GCCGCCGCAG CTGCTGCTTC CGCCGCCAGC GCCGTGCGCG
3721 GAATGGCCCT GGGCGCCGGC TACTACAGCT CTCTGGTGGC CAACTCGAGT TCCACCAATA
3781 ATCCCGCCAG CCTGAACGAG GAGAAGCTGC TGCTGCTGAT GGCCCAGCTC GAGGCCCTGA
3841 CCCAGCGCCT GGGCGAGCTG ACCCAGCAGG TGGCTCAGCT GCAGGCGGAG ACGCGGGCCG
3901 CGGTTGCCAC GGTGAAAACC AAATAAAAAA TGAATCAATA AATAAACGGA GACGGTTGTT
3961 GATTTTAACA CAGAGTCTTG AATCTTTATT TGATTTTTCG CGCGCGGTAG GCCCTGGACC
4021 ACCGGTCTCG ATCATTGAGC ACCCGGTGGA TCTTTTCCAG GACCCGGTAG AGGTGGGCTT
4081 GGATGTTGAG GTACATGGGC ATGAGCCCGT CCCGGGGGTG GAGGTAGCTC CATTGCAGGG
4141 CCTCGTGCTC GGGGATGGTG TTGTAAATCA CCCAGTCATA GCAGGGCGC AGGGCGTGGT
4201 GCTGCACGAT GTCCTTGAGG AGGAGACTGA TGGCCACGGG CAGCCCCTTG GTGTAGGTGT
4261 TGACGAACCT GTTGAGCTGG GAGGGATGCA TGCGGGGGA GATGAGATGC ATCTTGGCCT
4321 GGATCTTGAG ATTGGCGATG TTCCCGCCCA GATCCCGCCG GGGGTTCATG TTGTGCAGGA
4381 CCACCAGCAC GGTGTATCCG GTGCACTTGG GAATTTGTC ATGCAACTTG GAAGGGAAGG
4441 CGTGAAAGAA TTTGGAGACG CCCTTGTGAC CGCCCAGGTT TTCCATGCAC TCATCCATGA
4501 TGATGGCGAT GGGCCCGTGG GCGGCGGCCT GGGCAAAGAC GTTTCGGGGG TCGGACACAT
4561 CGTAGTTGTG GTCCTGGGTG AGCTCGTCAT AGGCCATTTT AATGAATTTG GGGCGGAGGG
4621 TGCCCGACTG GGGGACGAAG GTGCCCTCGA TCCCGGGGGC GTAGTTGCCC TCGCAGATCT
4681 GCATCTCCCA GGCCTTGAGC TCGGAGGGGG GGATCATGTC CACCTGCGGG GCGATGAAAA
4741 AAACGGTTTC CGGGGCGGGG GAGATGAGCT GGGCCGAAAG CAGGTTCCGG AGCAGCTGGG
4801 ACTTGCCGCA ACCGGTGGGG CCGTAGATGA CCCCGATGAC CGGCTGCAGG TGGTAGTTGA
4861 GGGAGAGACA GCTGCCGTCC TCGCGGAGGA GGGGGGCCAC CTCGTTCATC ATCTCGCGCA
4921 CATGCATGTT CTCGCGCACG AGTTCCGCCA GGAGGCGCTC GCCCCCAGC GAGAGGAGCT
4981 CTTGCAGCGA GGCGAAGTTT TTCAGCGGCT TGAGTCCGTC GGCCATGGGC ATTTTGGAGA
5041 GGGTCTGTTG CAAGAGTTCC AGACGGTCCC AGAGCTCGGT GATGTGCTCT AGGGCATCTC
5101 GATCCAGCAG ACCTCCTCGT TTCGCGGGTT GGGGCGACTG CGGGAGTAGG GCACCAGGCG
5161 ATGGGCGTCC AGCGAGGCCA GGGTCCGGTC CTTCCAGGGC CGCAGGGTCC GCGTCAGCGT
5221 GGTCTCCGTC ACGGTGAAGG GGTGCGCGCC GGGCTGGGCG CTTGCGAGGG TGCGCTTCAG
5281 GCTCATCCGG CTGGTCGAGA ACCGCTCCCG GTCGGCGCCC TGCGCGTCGG CCAGGTAGCA
5341 ATTGAGCATG AGTTCGTAGT TGAGCGCCTC GGCCGCGTGG CCCTTGGCGC GGAGCTTACC
5401 TTTGGAAGTG TGTCCGCAGA CGGGACAGAG GAGGGACTTG AGGGCGTAGA GCTTGGGGGC
5461 GAGGAAGACG GACTCGGGGG CGTAGGCGTC CGCGCCGCAG CTGGCGCAGA CGGTCTCGCA
5521 CTCCACGAGC CAGGTGAGGT CGGGGCGGTT GGGGTCAAAA ACGAGGTTTC CTCCGTGCTT
5581 TTTGATGCGT TTCTTACCTC TGGTCTCCAT GAGCTCGTGT CCCCGCTGGG TGACAAAGAG
5641 GCTGTCCGTG TCCCCGTAGA CCGACTTTAT GGGCCGGTCC TCGAGCGGGG TGCCGCGGTC
5701 CTCGTCGTAG AGGAACCCCG CCCACTCCGA GACGAAGGCC CGGGTCCAGG CCAGCACGAA
5761 GGAGGCCACG TGGGAGGGT AGCGGTCGTT GTCCACCAGC GGGTCCACCT TCTCCAGGGT
5821 ATGCAAGCAC ATGTCCCCCT CGTCCACATC CAGGAAGGTG ATTGGCTTGT AAGTGTAGGC
5881 CACGTGACCG GGGGTCCCGG CCGGGGGGGT ATAAAAGGGG GCGGGCCCCT GCTCGTCCTC
5941 ACTGTCTTCC GGATCGCTGT CCAGGAGCGC CAGCTGTTGG GGTAGGTATT CCCTCTCGAA
6001 GGCGGGCATG ACCTCGGCAC TCAGGTTGTC AGTTTCTAGA AACGAGGAGG ATTTGATATT
6061 GACGGTGCCG TTGGAGACGC CTTTCATGAG CCCCTCGTCC ATTTGGTCAG AAAAGACGAT
6121 CTTTTTGTTG TCGAGCTTGG TGGCGAAGGA GCCGTAGAGG GCGTTGGAGA GCAGCTTGGC
6181 GATGGAGCGC ATGGTCTGGT TCTTTTCCTT GTCGGCGCGC TCCTTGGCGG CGATGTTGAG
6241 CTGCACGTAC TCGCGCGCCA CGCACTTCCA TTCGGGGAAG ACGGTGGTGA GCTCGTCGGG
6301 CACGATTCTG ACCCGCCAGC CGCGGTTGTG CAGGGTGATG AGGTCCACGC TGGTGGCCAC
6361 CTCGCCGCGC AGGGGCTCGT TGGTCCAGCA GAGGCGCCCG CCCTTGCGCG AGCAGAAGGG
6421 GGGCAGCGGG TCCAGCATGA GCTCGTCGGG GGGTCGGCG TCCACGGTGA AGATGCCGGG
6481 CAGGAGCTCG GGTCGAAGT AGCTGATGCA GGTGCCCAGA TTGTCCAGCG CCGCTTGCCA
6541 GTCGCGCACG GCCAGCGCGC GCTCGTAGGG GCTGAGGGGC GTGCCCCAGG GCATGGGGTG
6601 CGTGAGCGCG GAGGCGTACA TGCCGCAGAT GTCGTAGACG TAGAGGGGCT CCTCGAGGAC
6661 GCCGATGTAG GTGGGGTAGC AGCGCCCCCC GCGGATGCTG GCGCGCACGT AGTCGTACAG
6721 CTCGTGCGAG GGCGCGAGGA GCCCCGTGCC GAGGTTGGAG CGTTGCGGCT TTTCGGCGCG
6781 GTAGACGATC TGGCGGAAGA TGGCGTGGGA GTTGGAGGAG ATGGTGGGCC TTTGAAGAT
6841 GTTGAAGTGG GCGTGGGGCA GGCCGACCGA GTCCCTGATG AAGTGGGCGT AGGAGTCCTG
6901 CAGCTTGGCG ACGAGCTCGG CGGTGACGAG GACGTCCAGG GCGCAGTAGT CGAGGGTCTC
```

FIG. 7B

```
 6961 TTGGATGATG TCATACTTGA GCTGGCCCTT CTGCTTCCAC AGCTCGCGGT TGAGAAGGAA
 7021 CTCTTCGCGG TCCTTCCAGT ACTCTTCGAG GGGGAACCCG TCCTGATCGG CACGGTAAGA
 7081 GCCCACCATG TAGAACTGGT TGACGGCCTT GTAGGCGCAG CAGCCCTTCT CCACGGGGAG
 7141 GGCGTAAGCT TGCGCGGCCT TGCGCAGGGA GGTGTGGGTG AGGGCGAAGG TGTCGCGCAC
 7201 CATGACCTTG AGGAACTGGT GCTTGAAGTC GAGGTCGTCG CAGCCGCCCT GCTCCCAGAG
 7261 TTGGAAGTCC GTCGCTTCT TGTAGGCGGG GTTAGGCAAA GCGAAAGTAA CATCGTTGAA
 7321 GAGGATCTTG CCCGCGCGGG GCATGAAGTT GCGAGTGATG CGGAAAGGCT GGGGCACCTC
 7381 GGCCCGGTTG TTCATGACCT GGGCGGCGAG GACGATCTCG TCGAAGCCGT TGATGTTGTG
 7441 CCCGACGATG TAGAGTTCCA CGAATCGCGG GCGGCCCTTG ACGTGGGGCA GCTTCTTGAG
 7501 CTCGTCGTAG GTGAGCTCGG CGGGGTCGCT GAGCCCGTGC TGCTCGAGGG CCCAGTCGGC
 7561 GACGTGGGGG TTGGCGCTGA GGAAGGAAGT CCAGAGATCC ACGGCCAGGG CGGTCTGCAA
 7621 GCGGTCCCGG TACTGACGGA ACTGTTGGCC CACGGCCATT TTTTCGGGGG TGACGCAGTA
 7681 GAAGGTGCGG GGTCGCCGT GCCANCGGTC CCACTTGAGC TGGAGGGCGA GGTCGTGGGC
 7741 GAGCTCGACG AGCGGCGGGT CCCCGGAGAG TTTCATGACC AGCATGAAGG GGACGAGCTG
 7801 CTTGCCGAAG GACCCCATCC AGGTGTAGGT TTCCACATCG TAGGTGAGGA AGAGCCTTTC
 7861 GGTGCGAGGA TGCGAGCCGA TGGGGAAGAA CTGGATCTCC TGCCACCAGT TGGAGGAATG
 7921 GCTGTTGATG TGATGGAAGT AGAAATGCCG ACGGCGCGCC GAGCACTCGT GCTTGTGTTT
 7981 ATACAAGCGT CCGCAGTGCT CGCAACGCTG CACGGGATGC ACGTGCTGCA CGAGCTGTAC
 8041 CTGGGTTCCT TTGGCGAGGA ATTTCAGTGG GCAGTGGAGC GCTGGCGGCT GCATCTCGTG
 8101 CTGTACTACG TCTTGGCCAT CGGCGTGGCC ATCGTCTGCC TCGATGGTGG TCATGCTGAC
 8161 GAGCCCGCGC GGGAGGCAGG TCCAGACCTC GGCTCGGACG GTCGGAGAG CGAGGACGAG
 8221 GGCGCGCAGG CCGGAGCTGT CCAGGGTCCT GAGACGCTGC GGAGTCAGGT CAGTGGGCAG
 8281 CGGCGGCGCG CGGTTGACTT GCAGGAGCTT TTCCAGGGCG CGCGGGAGGT CCAGATGGTA
 8341 CTTGATCTCC ACGGCGCCGT TGGTGGCTAC GTCCACGGCT TGCAGGGTGC CGTGCCCCTG
 8401 GGGCGCCACC ACCGTGCCCC GTTTCTTCTT GGGCGCTGCT TCCATGTCGG TCAGAAGCGG
 8461 CGGCGAGGAC GCGCGCCGGG CGGCAGGGGC GGCTCGGGGC CCGGAGGCAG GGGCGGCAGG
 8521 GGCACGTCGG CGCCGCGCGC GGGCAGGTTC TGGTACTGCG CCCGGAGAAG ACTGGCGTGA
 8581 GCGACGACGC GACGGTTGAC GTCCTGGATC TGACGCCTCT GGGTGAAGGC CACGGGACCC
 8641 GTGAGTTTGA ACCTGAAAGA GAGTTCGACA GAATCAATCT CGGTATCGTT GACGGCGGCC
 8701 TGCCGCAGGA TCTCTTGCAC GTCGCCCGAG TTGTCCTGGT AGGCGATCTC GGTCATGAAC
 8761 TGCTCGATCT CCTCCTCCTG AAGGTCTCCG CGGCCGGCGC GCTCGACGGT GGCCGCGAGG
 8821 TCGTTGGAGA TGCGGCCCAT GAGCTGCGAG AAGGCGTTCA TGCCGGCCTC GTTCCAGACG
 8881 CGGCTGTAGA CCACGGCTCC GTCGGGGTCG CGCGCGCGCA TGACCACCTG GGCGAGGTTG
 8941 AGCTCGACGT GGCGCGTGAA GACCGCGTAG TTGCAGAGGC GCTGGTAGAG GTAGTTGAGC
 9001 GTGGTGGCGA TGTGCTCGGT GACGAAGAAG TACATGATCC AGCGGCGGAG CGGCATCTCG
 9061 CTGACGTCGC CCAGGGCTTC CAAGCGTTCC ATGGCCTCGT AGAAGTCCAC GGCGAAGTTG
 9121 AAAAACTGGG AGTTGCGCGC CGAGACGGTC AACTCCTCCT CCAGAAGACG GATGAGCTCG
 9181 GCGATGGTGG CGCGCACCTC GCGCTCGAAG GCCCCGGGGG GCTCCTCTTC CATCTCCTCC
 9241 TCTTCCTCCT CCACTAACAT CTCTTCTACT TCCTCCTCAG GAGGCGGTGG CGGGGGAGGG
 9301 GCCCTGCGTC GCCGGCGGCG CACGGGCAGA CGGTCGATGA AGCGCTCGAT GGTCTCCCCG
 9361 CGCCGGCGAC GCATGGTCTC GGTGACGGCG CGCCCGTCCT CGCGGGGCCG CAGCATGAAG
 9421 ACGCCGCCGC GCATCTCCAG GTGGCCGCCG GGGGGGTCTC CGTTGGGCAG GGAGAGGGCG
 9481 CTGACGATGC ATCTTATCAA TTGACCCGTA GGGACTCCGC GCAAGGACCT GAGCGTCTCG
 9541 AGATCCACGG GATCCGAAAA CCGCTGAACG AAGGCTTCGA GCCAGTCGCA GTCGCAAGGT
 9601 AGGCTGAGCC CGGTTTCTTG TTCTTCGGGT ATTTGGTCGG GAGGCGGCGG GCGATGCTGC
 9661 TGGTGATGAA GTTGAAGTAG GCGGTCCTGA GACGGCGGAT GGTGGCGAGG AGCACCAGGT
 9721 CCTTGGGCCC GGCTTGCTGG ATGCGCAGAC GGTCGGCCAT GCCCCAGGCG TGGTCCTGAC
 9781 ACCTGGCGAG GTCCTTGTAG TAGTCCTGCA TGAGCCGCTC ACGGGCACC TCCTCCTCGC
 9841 CCGCGCGGCC GTGCATGCGC GTGAGCCCGA ACCCGCGCTG CGGCTGGACG AGCGCCAGGT
 9901 CGGCGACGAC GCGCTCGGTG AGGATGGCCT GCTGGATCTG GGTGAGGGTG GTCTGGAAGT
 9961 CGTCGAAGTC GACGAAGCGG TGGTAGGCTC CGGTGTTGAT GGTGTAGGAG CAGTTGGCCA
10021 TGACGGACCA GTTGACGGTC TGGTGGCCGG GTCGCACGAG CTCGTGGTAC TTGAGGCGCG
10081 AGTAGGCGCG CGTGTCGAAG ATGTAGTCGT TGCAGGCGCG CACGAGGTAC TGGTATCCGA
10141 CGAGGAAGTG CGGCGGCGGC TGGCGGTAGA GCGGCCATCG CTCGGTGGCG GGGCGCCGG
10201 GCGCGAGGTC CTCGAGCATG AGGCGGTGGT AGCCGTAGAT GTACCTGGAC ATCCAGGTGA
10261 TGCCGGCGGC GGTGGTGGAG GCGCGCGGGA ACTCGCGGAC GCGGTTCCAG ATGTTGCGCA
10321 GCGGCAGGAA GTAGTTCATG GTGGCCGCGG TCTGGCCCGT GAGGCGCGCG CAGTCGTGGA
10381 TGCTCTAGAC ATACGGGCAA AAACGAAAGC GGTCAGCGGC TCGACTCCGT GGCCTGGAGG
```

FIG. 7C

```
10441 CTAAGCGAAC GGGTTGGGCT GCGCGTGTAC CCCGGTTCGA ATCTCGAATC AGGCTGGAGC
10501 CGCAGCTAAC GTGGTACTGG CACTCCCGTC TCGACCCAAG CCTGCTAACG AAACCTCCAG
10561 GATACGGAGG CGGGTCGTTT TTTGGCCTTG GTCGCTGGTC ATGAAAAACT AGTAAGCGCG
10621 GAAAGCGGCC GCCCGCGATG GCTCGCTGCC GTAGTCTGGA GAAAGAATCG CCAGGGTTGC
10681 GTTGCGGTGT GCCCCGGTTC GAGCCTCAGC GCTCGGCGCC GGCGGATTC CGCGGCTAAC
10741 GTGGGCGTGG CTGCCCCGTC GTTTCCAAGA CCCCTTAGCC AGCCGACTTC TCCAGTTACG
10801 GAGCGAGCCC CTCTTTTTTT TTCTTGTGTT TTTGCCAGAT GCATCCCGTA CTGCGGCAGA
10861 TGCGCCCCCA CCCTCCACCA CAACCGCCCC TACCGCAGCA GCAGCAACAG CCGGCGCTTC
10921 TGCCCCCGCC CCAGCAGCAG CCAGCCACTA CCGCGGCGGC CGCCGTGAGC GGAGCCGGCG
10981 TTCAGTATGA CCTGGCCTTG GAAGAGGGCG AGGGGCTGGC GCGGCTGGGG GCGTCGTCGC
11041 CGGAGCGGCA CCCGCGCGTG CAGATGAAAA GGGACGCTCG CGAGGCCTAC GTGCCCAAGC
11101 AGAACCTGTT CAGAGACAGG AGCGGCGAGG AGCCCGAGGA GATGCGCGCC TCCCGCTTCC
11161 ACGCGGGGCG GGAGCTGCGG CGCGGCCTGA ACCGAAAGCG GGTGCTGAGG GACGAGGATT
11221 TCGAGGCGGA CGAGCTGACG GGGATCAGCC CCGTGCGCGC GCACGTGGTC GNGGNCAACC
11281 TGGTCACGGC GTACGAGCAG ACCGTGAAGG AGGAGAGCAA CTTCCAAAAA TCCTTCAACA
11341 ACCACGTGCG CACCTTGATC GCGCGCGAGG AGGTGACCCT GGGCCTGATG CACCTGTGGG
11401 ACCTGCTGGA GGCCATCGTG CAGAACCCCA CGAGCAAGCC GCTGACGGCG CAGCTGTTTC
11461 TGGTGGTGCA GCACAGTCGG ACAACGAGA CGTTCAGGGA GGCGCTGCTG AATATCACCG
11521 AGCCCGAGGG CCGCTGGCTC CTGGACCTGG TGAACATTTT GCAGAGCATC GTGGTGCAGG
11581 AGCGCGGGCT GCCGCTGTCC GAGAAGCTGG CGGCCATCAA CTTCTCGGTG CTGAGTCTGG
11641 GCAAGTACTA CGCTAGGAAG ATCTACAAGA CCCCGTACGT GCCCATAGAC AAGGAGGTGA
11701 AGATCGACGG GTTTTACATG CGCATGACCC TGAAAGTGCT GACCCTGAGC GACGATCTGG
11761 GGGTGTACCG CAACGACAGG ATGCACCGCG CGGTGAGCGC CAGCCGCCGG CGCGAGCTGA
11821 GCGACCAGGA GCTGATGCAC AGCCTGCAGC GGGCCCTGAC CGGGGCCGGG ACCGAGGGGG
11881 AGAGCTACTT TGACATGGGC GCGGACCTGC GCTGGCAGCC CAGCCGCCGG GCCTTGGAAG
11941 CTGCCGGCGG TTCCCCCTAC GTGGAGGAGG TGGACGATGA GGAGGAGGAG GGCGAGTACC
12001 TGGAAGACTG ATGGCGGGAC CGTATTTTG CTAGATGCAG CAACAGCCAC CGCCGCCGCC
12061 TCCTGATCCC GCGATGCGGG CGGCGCTGCA GAGCCAGCCG TCCGGCATTA ACTCCTCGGA
12121 CGATTGGACC CAGGCCATGC AACGCATCAT GGCGCTGACG ACCCGCAATC CCGAAGCCTT
12181 TAGACAGCAG CCTCAGGCCA ACCGGCTCTC GGCCATCCTG GAGGCCGTGG TGCCCTCGCG
12241 CTCGAACCCC ACGCACGAGA AGGTGCTGGC CATCGTGAAC GCGCTGGTGG AGAACAAGGC
12301 CATCCGCGGT GACGAGGCCG GCTGGTGTA CAACGCGCTG CTGGAGCGCG TGGCCCGCTA
12361 CAACAGCACC AACGTGCAGA CGAACCTGGA CCGCATGGTG ACCGACGTGC GCGAGGCGGT
12421 GTCGCAGCGC GAGCGGTTCC ACCGCGAGTC GAACCTGGGC TCCATGGTGG CGCTGAACGC
12481 CTTCCTGAGC ACGCAGCCCG CCAACGTGCC CCGGGGCCAG GAGGACTACA CCAACTTCAT
12541 CAGCGCGCTG CGGCTGATGG TGGCCGAGGT GCCCCAGAGC GAGGTGTACC AGTCGGGGCC
12601 GGACTACTTC TTCCAGACCA GTCGCCAGGG CTTGCAGACC GTGAACCTGA GCCAGGCTTT
12661 CAAGAACTTG CAGGGACTGT GGGGCGTGCA GGCCCCGGTC GGGGACCGCG CGACGGTGTC
12721 GAGCCTGCTG ACGCCGAACT CGCGCCTGCT GCTGCTGCTG GTGGCGCCCT TCACGGACAG
12781 CGGCAGCGTG AGCCGCGACT CGTACCTGGG CTACCTGCTT AACCTGTACC GCGAGGCCAT
12841 CGGACAGGCG CACGTGGACG AGCAGACCTA CCAGGAGATC ACCCACGTGA GCCGCGCGCT
12901 GGGCCAGGAG GACCCGGGCA ACCTGGAGGC CACCCTGAAC TTCCTGCTGA CCAACCGGTC
12961 GCAGAAGATC CCGCCCCAGT ACGCGCTGAG CACCGAGGAG GAGCGCATCC TGCGCTACGT
13021 GCAGCAGAGC GTGGGGCTGT TCCTGATGCA GGAGGGGGCC ACGCCCAGCG CGGCGCTCGA
13081 CATGACCGCG CGCAACATGG AGCCCAGCAT GTACGCCCGC AACGCCCGT TCATCAATAA
13141 GCTGATGGAC TACTTGCATC GGGCGGCCGC CATGAACTCG ACTACTTTA CCAACGCCAT
13201 CTTGAACCCG CACTGGCTCC CGCCGCCCGG GTTCTACACG GGCGAGTACG ACATGCCCGA
13261 CCCCAACGAC GGGTTCCTGT GGGACGACGT GGACAGCAGC GTGTTCTCGC CGCGTCCAGG
13321 AACCAATGCC GTGTGGAAGA AGAGGGCGG GGACCGGCGG CCGTCCTCGG CGCTGTCCGG
13381 TCGCGCGGGT GCTGCCGCGG CGGTGCCCGA GGCCGCCAGC CCCTTCCCGA GCCTGCCCTT
13441 TTCGCTGAAC AGCGTGCGCA GCAGCGAGCT GGGTCGGCTG ACGCGACCGC GCCTGCTGGG
13501 CGAGGAGGAG TACCTGAACG ACTCCTTGTT GAGGCCCGAG CGCGAGAAGA ACTTCCCCAA
13561 TAACGGGATA GAGAGCCTGG TGGACAAGAT GAGCCGCTGG AAGACGTACG CGCACGAGCA
13621 CAGGGACGAG CCCCGAGCTA GCAGCGCAGG CACCCGTAGA CGCCAGCGGC ACGACAGGCA
13681 GCGGGGACTG GTGTGGGACG ATGAGGATTC CGCCGACGAC AGCAGCGTGT GGACTTGGG
13741 TGGGAGTGGT GGTAACCCGT TCGCTCACCT GCGCCCCCGT ATCGGGCGCC TGATGTAAGA
13801 ATCTGAAAAA ATAAAAGACG GTACTCACCA AGGCCATGGC GACCAGCGTG CGTTCTTCTC
13861 TGTTGTTTGT AGTAGTATGA TGAGGCGCGT GTACCCGGAG GGTCCTCCTC CCTCGTACGA
```

FIG. 7D

```
13921 GAGCGTGATG CAGCAGGCGG TGGCGGCGGC GATGCAGCCC CCGCTGGAGG CGCCTTACGT
13981 GCCCCCGCGG TACCTGGCGC CTACGAGGG GCGGAACAGC ATTCGTTACT CGGAGCTGGC
14041 ACCCTTGTAC GATACCACCC GGTTGTACCT GGTGGACAAC AAGTCGGCAG ACATCGCCTC
14101 GCTGAACTAC CAGAACGACC ACAGCAACTT CCTGACCACC GTGGTGCAGA CAACGATTT
14161 CACCCCCACG GAGGCCAGCA CCCAGACCAT CAACTTTGAC GAGCGCTCGC GGTGGGGCGG
14221 CCAGCTGAAA ACCATCATGC ACACCAACAT GCCCAACGTG AACGAGTTCA TGTACAGCAA
14281 CAAGTTCAAG GCGCGGGTGA TGGTCTCGCG CAAGACCCCC AACGGGGTGG ATGATGATTA
14341 TGATGGTAGT CAGGACGAGC TGACCTACGA GTGGGTGGAG TTTGAGCTGC CCGAGGGCAA
14401 CTTCTCGGTG ACCATGACCA TCGATCTGAT GAACAACGCC ATCATCGACA ACTACTTGGC
14461 GGTGGGGCGG CAGAACGGGG TGCTGGAGAG CGACATCGGC GTGAAGTTCG ACACGCGCAA
14521 CTTCCGGCTG GGCTGGGACC CCGTGACCGA GCTGGTGATG CCGGGCGTGT ACACCAACGA
14581 GGCCTTCCAC CCCGACATCG TCCTGCTGCC CGGCTGCGGC GTGGACTTCA CCGAGAGCCG
14641 CCTCAGCAAC CTGCTGGGCA TCCGCAAGCG GCAGCCCTTC CAGGAGGGCT TCCAGATCCT
14701 GTACGAGGAC CTGGAGGGGG GCAACATCCC CGCGCTCTTG GATGTCGAAG CCTACGAGAA
14761 AAGCAAGGAG GATAGCACCG CCGCGGCGAC CGCAGCCGTG GCCACCGCCT CTACCGAGGT
14821 GCGGGCGAT AATTTTGCTA GCGCTGCGGC AGCGGCCGAG GCGGCTGAAA CCGAAAGTAA
14881 GATAGTCATC CAGCCGGTGG AGAAGGACAG CAAGGACAGG AGCTACAACG TGCTCGCGGA
14941 CAAGAAAAC ACCGCCTACC GCAGCTGGTA CCTGGCCTAC AACTACGGCG ACCCCGAGAA
15001 GGGCGTGCGC TCCTGGACGC TGCTCACCAC CTCGGACGTC ACCTGCGGCG TGGAGCAAGT
15061 CTACTGGTCG CTGCCCGACA TGATGCAAGA CCCGGTCACC TTCCGCTCCA CGCGTCAAGT
15121 TAGCAACTAC CCGGTGGTGG GCGCCGAGCT CCTGCCCGTC TACTCCAAGA GCTTCTTCAA
15181 CGAGCAGGCC GTCTACTCGC AGNAGCTGCG CGCCTTCACC TCGCTCACGC ACGTCTTCAA
15241 CCGCTTCCCC GAGAACCAGA TCCTCGTCCG CCGCCGCGCC CACCATTACC ACCGTCAGTG
15301 AAAACGTTCC TGCTCTCACA GATCACGGGA CCCTGCCGCT GCGCAGCAGT ATCCGGGGAG
15361 TCCAGCGCGT GACCGTCACT GACGCCAGAC GCCGCACCTG CCCCTACGTC TACAAGGCCC
15421 TGGGCGTAGT CGCGCCGCGC GTCCTCTCGA GCCGCACCTT CTAAAAAATG TCCATTCTCA
15481 TCTCGCCCAG TAATAACACC GGTTGGGGCC TGCGCGCGCC CAGCAAGATG TACGGAGGCG
15541 CTCGCCAACG CTCCACGCAA CACCCCGTGC GCGTGCGCGG GCACTTCCGC GCTCCCTGGG
15601 GCGCCCTCAA GGGCCGCGTG CGCTCGCGCA CCACCGTCGA CGACGTGATC GACCAGGTGG
15661 TGGCCGACGC GCGCAACTAC ACGCCCGCCG CCGCGCCCGT CTCCACCGTG GACGCCGTCA
15721 TCGACAGCGT GGTGGCCGAC GGGCGCCGGT ACGCCCGCAC CAAGAGCCGG CGGCGGCGCA
15781 TCGCCCGGCG GCACCGGAGC ACCCCCGCCA TGCGCGCGGC GCGAGCCTTG CTGCGCAGGG
15841 CCAGGCGCAC GGGACGCAGG GCCATGCTCA GGGCGGCCAG ACGCGCGGCC TCCGGCAGCA
15901 GCAGCGCCGG CAGGACCCGC AGACGCGCGG CCACGGCGGC GGCGGCGGCC ATCGCCAGCA
15961 TGTCCCGCCC GCGGCGCGGC AACGTGTACT GGGTGCGCGA CGCCGCCACC GGTGTGCGCG
16021 TGCCCGTGCG CACCCGCCCC CCTCGCACTT GAAGATGCTG ACTTCGCGAT GTTGATGTGT
16081 CCCAGCGGCG AGGAGGATGT CCAAGCGCAA ATACAAGGAA GAGATGCTCC AGGTCATCGC
16141 GCCTGAGATC TACGGCCCCG CGGCGGCGGT GAAGGAGGAA AGAAAGCCCC GCAAACTGAA
16201 GCGGGTCAAA AAGGACAAAA AGGAGGAGGA AGATGACGGA CTGGTGGAGT TTGTGCGCGA
16261 GTTCGCCCCC CGGCGGCGCG TGCAGTGGCG CGGGCGGAAA GTGAAACCGG TGCTGCGGCC
16321 CGGCACCACG GTGGTCTTCA CGCCCGGCGA GCGTTCCGGC TCCGCCTCCA AGCGCTCCTA
16381 CGACGAGGTG TACGGGACG AGGACATCCT CGAGCAGGCC GTCGAGCGTC TGGGCGAGTT
16441 TGCGTACGGC AAGCGCAGCC GCCCCGCGCC CTTGAAAGAG GAGGCGGTGT CCATCCCGCT
16501 GGACCACGGC AACCCCACGC CGAGCCTGAA GCCGGTGACC CTGCAGCAGG TGCTACCGAG
16561 CGCGGCGCCG CGCCGGGGCT TCAAGCGCGA GGGCGGCGAG GATCTGTACC CGACCATGCA
16621 GCTGATGGTG CCCAAGCGCC AGAAGCTGGA GGACGTGCTG GAGCACATGA AGGTGGACCC
16681 CGAGGTGCAG CCCGAGGTCA AGGTGCGGCC CATCAAGCAG GTGGCCCCGG GCCTGGGCGT
16741 GCAGACCGTG GACATCAAGA TCCCCACGGA GCCCATGGAA ACGCAGACCG AGCCCGTGAA
16801 GCCCAGCACC AGCACCATGG AGGTGCAGAC GGATCCCTGG ATGCCAGCAC CAGCTTCCAC
16861 CAGCACTCGC CGAAGACGCA AGTACGGCGC GGCCAGCCTG CTGATGCCCA ACTACGCGGC
16921 TGCATCCTTC CATCATCCCC ACGCCGGGCT ACCGCGGCAC GCGCTTCTAC CGCGGCTACA
16981 CCAGCAGCCG CCGCCGCAAG ACCACCACCC GCCGCCGTCG TCGCAGCCGC CGCAGCAGCA
17041 CCGCGACTTC CGCCTTGGTG CGGAGAGTGT ATCGCAGCGG GCGCGAGCCT CTGACCCTGC
17101 CGCGCGCGCG CTACCACCCG AGCATCGCCA TTTAACTACC GCCTCCTACT TGCAGATATG
17161 GCCCTCACAT GCCGCCTCCG CGTCCCCATT ACGGGCTACC GAGGAAGAAA GCCGCGCCGT
17221 AGAAGGCTGA CGGGGAACGG GCTGCGTCGC CATCACCACC GGCGGCGGCG CGCCATCAGC
17281 AAGCGGTTGG GGGGAGGCTT CCTGCCCGCG CTGATCCCCA TCATCGCCGC GGCGATCGGG
17341 GCGATCCCCG GCATAGCTTC CGTGGCGGTG CAGGCCTCTC AGCGCCACTG AGACACAAAA
```

FIG. 7E

```
17401 AAGCATGGAT TTGTAATAAA AAAAAAAATG GACTGACGCT CCTGGTCCTG TGATGTGTGT
17461 TTTTAGATGG AAGACATCAA TTTTTCGTCC CTGGCACCGC GACACGGCAC GCGGCCGTTT
17521 ATGGGCACCT GGAGCGACAT CGGCAACAGC CAACTGAACG GGGGCGCCTT CAATTGGAGC
17581 AGTCTCTGGA GCGGGCTTAA GAATTTCGGG TCCACGCTCA AAACCTATGG CAACAAGGCG
17641 TGGAACAGCA GCACAGGGCA GGCGCTGAGG GAAAAGCTGA AAGAACAGAA CTTCCAGCAG
17701 AAGGTGGTTG ATGGCCTGGC CTCAGGCATC AACGGGGTGG TTGACCTGGC CAACCAGGCC
17761 GTGCAGAAAC AGATCAACAG CCGCCTGGAC GCGGTCCCGC CCGCGGGGTC CGTGGAGATG
17821 CCCCAGGTGG AGGAGGAGCT GCCTCCCCTG GACAAGCGCG GCGACAAGCG ACCGCGTCCC
17881 GACGCGGAGG AGACGCTGCT GACGCACACG GACGAGCCGC CCCCGTACGA GGAGGCGGTG
17941 AAACTGGGCC TGCCCACCAC GCGGCCCGTG GCGCCTCTGG CCACCGGAGT GCTGAAACCC
18001 AGCAGCAGCC AGCCCGCGAC CCTGGACTTG CCTCCGCCTC GCCCCTCCAC AGTGGCTAAG
18061 CCCCTGCCGC CGGTGGCCGT CGCGTCGCGC GCCCCCCGAG GCCGCCCCCA GGCGAACTGG
18121 CAGAGCACTC TGAACAGCAT CGTGGGTCTG GGAGTGCAGA GTGTGAAGCG CCGCCGCTGC
18181 TATTAAAAGA CACTGTAGCG CTTAACTTGC TTGTCTGTGT GTATATGTAT GTCCGCCGAC
18241 CAGAAGGAGG AGTGTGAAGA GGCGCGTCGC CGAGTTGCAA GATGGCCACC CCATCGATGC
18301 TGCCCCAGTG GGCGTACATG CACATCGCCG GACAGGACGC TTCGGAGTAC CTGAGTCCGG
18361 GTCTGGTGCA GTTCGCCCGC GCCACAGACA CCTACTTCAG TCTGGGGAAC AAGTTTAGGA
18421 ACCCCACGGT GGCGCCCACG CACAATGTGA CCACCGACCG CAGCCAGCGG CTGACGGTGC
18481 GCTTCGTGCC CGTGGACCGC GAGGACAACA CCTACTCGTA CAAAGTGCGC TACACGCTGG
18541 CCGTGGGCGA CAACCGCGTG CTGGACATGG CCAGCACCTA CTTTGACATC CGCGGCGTGC
18601 TGGACCGGGG CCCTAGCTTC AAACCCTACT CTGGCACCGC CTACAACAGC CTAGCTCCCA
18661 AGGGAGCTCC CAATTCCAGC CAGTGGGAGC AAGCAAAAAC AGGCAATGGG GGAACTATGG
18721 AAACACACAC ATATGGTGTG GCCCCAATGG GCGGAGAGAA TATTACAAAA GATGGTCTTC
18781 AAATTGGAAC TGACGTTACA GCGAATCAGA ATAAACCAAT TTATGCCGAC AAAACATTTC
18841 AACCAGAACC GCAAGTAGGA GAAGAAAATT GGCAAGAAAC TGAAAACTTT TATGGCGGTA
18901 GAGCTCTTAA AAAAGACACA AACATGAAAC CTTGCTATGG CTCCTATGCT AGACCCACCA
18961 ATGAAAAAGG AGGTCAAGCT AAACTTAAAG TTGGAGATGA TGGAGTTCCA ACCAAAGAAT
19021 TCGACATAGA CCTGGCTTTC TTTGATACTC CCGGTGGCAC CGTGAACGGT CAAGACGAGT
19081 ATAAAGCAGA CATTGTCATG TATACCGAAA ACACGTATTT GGAAACTCCA GACACGCATG
19141 TGGTATACAA ACCAGGCAAG GATGATGCAA GTTCTGAAAT TAACCTGGTT CAGCAGTCTA
19201 TGCCCAACAG ACCCAACTAC ATTGGGTTCA GGGACAACTT TATCGGTCTT ATGTACTACA
19261 ACAGCACTGG CAATATGGGT GTGCTTGCTG GTCAGGCCTC CCAGCTGAAT GCTGTGGTTG
19321 ATTTGCAAGA CAGAAACACC GAGCTGTCCT ACCAGCTCTT GCTTGACTCT TTGGGTGACA
19381 GAACCCGGTA TTTCAGTATG TGGAACCAGG CGGTGGACAG TTATGACCCC GATGTGCGCA
19441 TCATCGAAAA CCATGGTGTG GAGGATGAAT TGCCAAACTA TTGCTTCCCC TTGGACGGCT
19501 CTGGCACTAA CGCCGCATAC CAAGGTGTGA AGTAAAAGA TGGTCAAGAT GGTGATGTTG
19561 AGAGTGAATG GGAAAATGAC GATACTGTTG CAGCTCGAAA TCAATTATGT AAAGGTAACA
19621 TTTTCGCCAT GGAGATTAAT CTCCAGGCTA ACCTGTGGAG AAGTTTCCTC TACTCGAACG
19681 TGCCCCTGTA CCTGCCCGAC TCCTACAAGT ACACGCCGAC CAACGTCACG CTGCCGACCA
19741 ACACCAACAC CTACGATTAC ATGAATGGCA GAGTGACACC TCCCTCGCTG GTAGACGCCT
19801 ACCTCAACAT CGGGGCGCGC TGGTCGCTGG ACCCCATGGA CAACGTCAAC CCCTTCAACC
19861 ACCACCGCAA CGCGGGCCTG CGCTACCGCT CCATGCTCCT GGGCAACGGG CGCTACGTGC
19921 CCTTCCACAT CCAGGTGCCC CAAAAGTTTT TCGCCATCAA GAGCCTCCTG CTCCTGCCCG
19981 GGTCCTACAC CTACGAGTGG AACTTCCGCA AGGACGTCAA CATGATCCTG CAGAGCTCCC
20041 TAGGCAACGA CCTGCGCACG GACGGGGCCT CCATCGCCTT CACCAGCATC AACCTCTACG
20101 CCACCTTCTT CCCCATGGCG CACAACACCG CCTCCACGCT CGAGGCCATG CTGCGCAACG
20161 ACACCAACGA CCAGTCCTTC AACGACTACC TCTCGGCGGC CAACATGCTC TACCCCATCC
20221 CGGCCAACGC CACCAACGTG CCCATCTCCA TCCCCTCGCG CAACTGGGCC GCCTTCCGCG
20281 GATGGTCCTT CACGCGCCTG AAGACCCGCG AGACGCCCTC GCTCGGCTCC GGGTTCGACC
20341 CCTACTTCGT CTACTCGGGC TCCATCCCCT ACCTAGACGG CACCTTCTAC CTCAACCACA
20401 CCTTCAAGAA GGTCTCCATC ACCTTCGACT CCTCCGTCAG CTGGCCCGGC AACGACCGCC
20461 TCCTGACGCC CAACGAGTTC GAAATCAAGC GCACCGTCGA CGGAGAGGGA TACAACGTGG
20521 CCCAGTGCAA CATGACCAAG GACTGGTTCC TGGTCCAGAT GCTGGCCCAC TACAACATCG
20581 GCTACCAGGG CTTCTACGTG CCCGAGGGCT ACAAGGACCG CATGTACTCC TTCTTCCGCA
20641 ACTTCCAGCC CATGAGCCGC CAGGTCGTGG ACGAGGTCAA CTACAAGGAC TACCAGGCCG
20701 TCACCCTGGC CTACCAGCAC AACAACTCGG GCTTCGTCGG CTACCTCGCG CCCACCATGC
20761 GCCAGGGCCA GCCCTACCCC GCCAACTACC CCTACCCGCT CATCGGCAAG AGCGCCGTCG
20821 CCAGCGTCAC CCAGAAAAAG TTCCTCTGCG ACCGGGTCAT GTGGCGCATC CCCTTCTCCA
```

FIG. 7F

```
21661 GCTTCCTCAA TGCCCACTCC GCCTACTTTC GCTCCCACCG CGCGCGCATC GAGAAGGCCA
20881 GCAACTTCAT GTCCATGGGC GCGCTCACCG ACCTCGGCCA GAACATGCTC TACGCCAACT
20941 CCGCCCACGC GCTAGACATG AATTTCGAAG TCGACCCCAT GGATGAGTCC ACCCTTCTCT
21001 ATGTTGTCTT CGAAGTCTTC GACGTCGTCC GAGTGCACCA GCCCCACCGC GGCGTCATCG
21061 AAGCCGTCTA CCTGCGCACG CCCTTCTCGG CCGGCAACGC CACCACCTAA GCCGCTCTTG
21121 CTTCTTGCAA GATGACGGCG GGCTCCGGCG AGCAGGAGCT CAGGGCCATC CTCCGCGACC
21181 TGGGCTGCGG GCCCTGCTTC CTGGGCACCT TCGACAAGCG CTTCCCTGGA TTCATGGCCC
21241 CGCACAAGCT GGCCTGCGCC ATCGTGAACA CGGCCGGCCG CGAGACCGGG GGCGAGCACT
21301 GGCTGGCCTT CGCCTGGAAC CCGCGCTCCC ACACATGCTA CCTCTTCGAC CCCTTCGGGT
21361 TCTCGGACGA GCGCCTCAAG CAGATCTACC AGTTCGAGTA CGAGGGCCTG CTGCGTCGCA
21421 GCGCCCTGGC CACCGAGGAC CGCTGCGTCA CCCTGGAAAA GTCCACCCAG ACCGTGCAGG
21481 GTCCGCGCTC GGCCGCCTGC GGGCTCTTCT GCTGCATGTT CCTGCACGCC TTCGTGCACT
21541 GGCCCGACCG CCCCATGGAC AAGAACCCCA CCATGAACTT ACTGACGGGG GTGCCCAACG
21601 GCATGCTCCA GTCGCCCCAG GTGGAACCCA CCCTGCGCCG CAACCAGGAA GCGCTCTACC
21721 CCGCCTTCGA CCGCATGAAT CAAGACATGT AAAAAACCGG TGTGTGTATG TGAATGCTTT
21781 ATTCATAATA AACAGCACAT GTTTATGCCA CCTTCTCTGA GGCTCTGACT TTATTTAGAA
21841 ATCGAAGGGG TTCTGCCGGC TCTCGGCATG GCCCGCGGGC AGGGATACGT TGCGGAACTG
21901 GTACTTGGGC AGCCACTTGA ACTCGGGGAT CAGCAGCTTG GGCACGGGGA GGTCGGGGAA
21961 CGAGTCGCTC CACAGCTTGC GCGTGAGTTG CAGGGCGCCC AGCAGGTCGG GCGCGGAGAT
22021 CTTGAAATCG CAGTTGGGAC CCGCGTTCTG CGCGCGAGAG TTGCGGTACA CGGGGTTGCA
22081 GCACTGGAAC ACCATCAGGG CCGGGTGCTT CACGCTTGCC AGCACCGTCG CGTCGGTGAT
22141 GCCCTCCACG TCCAGATCCT CGGCGTTGGC CATCCCGAAG GGGTCATCT TGCAGGTCTG
22201 CCGCCCCATG CTGGGCACGC AGCCGGGCTT GTGGTTGCAA TCGCAGTGCA GGGGGATCAG
22261 CATCATCTGG GCCTGCTCGG AGCTCATGCC CGGGTACATG GCCTTCATGA AAGCCTTCAG
22321 CTGGCGGAAG GCCTGCTGCG CCTTGCCGCC CTCGGTGAAG AAGACCCCGC AGGACTTGCT
22381 AGAGAACTGG TTGGTGGCGC AGCCGGCGTC GTGCACGCAG CAGCGCGCGT CGTTGTTGGC
22441 CAGCTGCACC ACGCTGCGCC CCCAGCGGTT CTGGGTGATC TTGGCCCGGT TGGGGTTCTC
22501 CTTCAGCGCG CGCTGCCCGT TCTCGCTCGC CACATCCATC TCGATAGTGT GCTCCTTCTG
22561 GATCATCACG GTCCCGTGCA GGCACCGCAG CTTGCCCTCG GCTTCGGTGC AGCCGTGCAG
22621 CCACAGCGCG CAGCCGGTGC ACTCCCAGTT CTTGTGGGCG ATCTGGGAGT GCGAGTGCAC
22681 GAAGCCCTGC AGGAAGCGGC CCATCATCGC GGTCAGGGTC TTGTTGCTGG TGAAGGTCAG
22741 CGGGATGCCG CGGTGCTCCT CGTTCACATA CAGGTGGCAG ATGCGGCGGT ACACCTCGCC
22801 CTGCTCGGGC ATCAGCTGGA AGGCGGACTT CAGGTCGCTC TCCACGCGGT ACCGGTCCAT
22861 CAGCAGCGTC ATCACTTCCA TGCCCTTCTC CCAGGCCGAA ACGATCGGCA GGCTCAGGGG
22921 GTTCTTCACC GCCATTGTCA TCTTAGTCGC CGCCGCCGAG GTCAGGGGT CGTTCTCGTC
22981 CAGGGTCTCA AACACTCGCT TGCCGTCCTT CTCGATGATG CGCACGGGGG AAAGCTGAA
23041 GCCCACGGCC GCCAGCTCCT CCTCGGCCTG CCTTTCGTCC TCGCTGTCCT GGCTGATGTC
23101 TTGCAAAGGC ACATGCTTGG TCTTGCGGGG TTTCTTTTTG GCGGCAGAG GCGGCGGCGA
23161 TGTGCTGGGA GAGCGCGAGT CTCGTTCAC CACGACTATT TCTTCTTCTT GGCCGTCGTC
23221 CGAGACCACG CGGCGGTAGG CATGCCTCTT CTGGGGCAGA GGCGGAGGCG ACGGGCTCTC
23281 GCGGTTCGGC GGGCGGCTGG CAGAGCCCCT TCCGCGTTCG GGGGTGCGCT CCTGGCGGCG
23341 CTGCTCTGAC TGACTTCCTC CGCGGCCGGC CATTGTGTTC TCCTAGGGAG CAACAACAAG
23401 CATGGAGACT CAGCCATCGT CGCCAACATC GCCATCTGCC CCGCCGCCA CCGCCGACGA
23461 GAACCAGCAG CAGAATGAAA GCTTAACCGC CCCGCCGCCC AGCCCCACCT CCGACGCCGC
23521 GGCCCCAGAC ATGCAAGAGA TGGAGGAATC CATCGAGATT GACCTGGGCT ACGTGACGCC
23581 CGCGGAGCAC GAGGAGGAGC TGGCAGCGCG CTTTTCAGCC CCGGAAGAGA ACCACCAAGA
23641 GCAGCCAGAG CAGGAAGCAG AGAACGAGCA GAACCAGGCT GGGCACGAGC ATGGCGACTA
23701 CCTGAGCGGG GCAGAGGACG TGCTCATCAA GCATCTGGCC CGCCAATGCA TCATCGTCAA
23761 GGACGCGCTG CTCGACCGCG CCGAGGTGCC CCTCAGCGTG GCGGAGCTCA GCGCGCCTA
23821 CGAGCGCAAC CTCTTCTCGC CGCGCGTGCC CCCCAAGCGC CAGCCCAACG GCACCTGTGA
23881 GCCCAACCCG CGCCTCAACT TCTACCCGGT CTTCGCGGTG CCCGAGGCCC TGGCCACCTA
23941 CCACCTCTTT TTCAAGAACC AAAGGATCCC CGTCTCCTGC CGCGCCAACC GCACCCGCGC
24001 CGACGCCCTG CTCAACCTGG GCCCCGGCGC CCGCCTACCT GATATCACCT CCTTGGAAGA
24061 GGTTCCCAAG ATCTTCGAGG GTCTGGGCAG CGACGAGACT CGGGCCGCGA ACGCTCTGCA
24121 AGGAAGCGGA GAGGAGCATG AGCACCACAG CGCCCTGGTG GAGTTGGAAG CGACAACGC
24181 GCGCCTGGCG GTCCTCAAGC GCACGGTCGA GCTGACCCAC TTCGCCTACC CGGCGCTCAA
24241 CCTGCCCCCC AAGGTCATGA GCGCCGTCAT GGACCAGGTG CTCATCAAGC GCGCCTCGCC
24301 CCTCTCGGAG GAGGAGATGC AGGACCCCGA GAGTTCGGAC GAGGGCAAGC CCGTGGTCAG
```

FIG. 7G

```
24361 CGACGAGCAG CTGGCGCGCT GGCTGGGAGC GAGTANCACC CCCCAGAGCC TGGAAGAGCG
24421 GCGCAAGCTC ATGATGGCCG TGGTCCTGGT GACCGTGGAG CTGGAGTGTC TGCGCCGCTT
24481 CTTTGCCGAC GCGGAGACCC TGCGCAAGGT CGAGGAGAAC CTGCACTACC TCTTCAGGCA
24541 CGGGTTCGTG CGCCAGGCCT GCAAGATCTC CAACGTGGAG CTGACCAACC TGGTCTCCTA
24601 CATGGGCATC CTGCACGAGA ACCGCCTGGG GCAAAACGTG CTGCACACCA CCCTGCGCGG
24661 GGAGGCCCGC CGCGACTACA TCCGCGACTG CGTCTACCTG TACCTCTGCC ACACCTGGCA
24721 GACGGGCATG GGCGTGTGGC AGCAGTGCCT GGAGGAGCAG AACCTGAAAG AGCTCTGCAA
24781 GCTCCTGCAG AAGAACCTCA AGGCCCTGTG GACCGGGTTC GACGAGCGTA CCACCGCCTC
24841 GGACCTGGCC GACCTCATCT TCCCCGAGCG CCTGCGGCTG ACGCTGCGCA ACGGGCTGCC
24901 CGACTTTATG AGCCAAAGCA TGTTGCAAAA CTTTCGCTCT TTCATCCTCG AACGCTCCGG
24961 GATCCTGCCC GCCACCTGCT CCGCGCTGCC CTCGGACTTC GTGCCGCTGA CCTTCGCCGA
25021 GTGCCCCCCG CCGCTCTGGA GCCACTGCTA CTTGCTGCGC CTGGCCAACT ACCTGGCCTA
25081 CCACTCGGAC GTGATCGAGG ACGTCAGCGG CGAGGGTCTG CTGGAGTGCC ACTGCCGCTG
25141 CAACCTCTGC ACGCCGCACC GCTCCCTGGC CTGCAACCCC CAGCTGCTGA GCGAGACCCA
25201 GATCATCGGC ACCTTCGAGT TGCAAGGCCC CGGCGACGGC GAGGGCAAGG GGGGTCTGAA
25261 ACTCACCCCG GGGCTGTGGA CCTCGGCCTA CTTGCGCAAG TTCGTGCCCG AGGACTACCA
25321 TCCCTTCGAG ATCAGGTTCT ACGAGGACCA ATCCCAGCCG CCCAAGGCCG AGCTGTCGGC
25381 CTGCGTCATC ACCCAGGGGG CCATCCTGGC CCAATTGCAA GCCATCCAGA AATCCCGCCA
25441 AGAATTTCTG CTGAAAAAGG GCCACGGGGT CTACTTGGAC CCCCAGACCG GAGAGGAGCT
25501 CAACCCCAGC TTCCCCCAGG ATGCCCCGAG GAAGCAGCAA GAAGCTGAAA GTGGAGCTGC
25561 CGCCGCCGGA GGATTTGGAG GAAGACTGGG AGAGCAGTCA GGCAGAGGAG GAGGAGATGG
25621 AAGACTGGGA CAGCACTCAG GCAGAGGAGG ACAGCCTGCA AGACAGTCTG GAGGAGGAAG
25681 ACGAGGTGGA GGAGGCAGAG GAAGAAGCAG CCGCCGCCAG ACCGTCGTCC TCGGCGGAGA
25741 AAGCAAGCAG CACGGATACC ATCTCCGCTC CGGGTCGGGG TCGCGGCGGC CGGGCCCACA
25801 GTAGGTGGGA CGAGACCGGG CGCTTCCGAA CCCCACCACC CAGACCGGTA AGAAGGAGCG
25861 GCAGGGATAC AAGTCCTGGC GGGGGCACAA AAACGCCATC GTCTCCTGCT TGCAAGCCTG
25921 GGGGGCAAC ATCTCCTTCA CCCGGCGCTA CCTGCTCTTT ACCGCGGGG TGAACTTCCC
25981 CCGCAACATC TTGCATTACT ACCGTCACCT CCACAGCCCC TACTACTGTT CCAAGAAGA
26041 GGCAGAAACC CAGCAGCAGC AGAAAACCAG CGGCAGCAGC AGCTAGAAAA TCCACAGCGG
26101 CGGCAGGTGG ACTGAGGATC GCGGCGAACG AGCCGGCGCA GACCCGGGAG CTGAGGAACC
26161 GGATCTTTCC CACCCTCTAT GCCATCTTCC AGCAGAGTCG GGGGCAGGAG CAGGAACTGA
26221 AAGTCAAGAA CCGTTCTCTG CGCTCGCTCA CCCGCAGTTG TCTGTATCAC AAGAGCGAAG
26281 ACCAACTTCA GCGCACTCTC GAGGACGCCG AGGCTCTCTT CAACAAGTAC TGCGCGCTCA
26341 CTCTTAAAGA GTAGCCCGCG CCCGCCCACA CACGGAAAAA GGCGGGAATT ACGTCACCAC
26401 CTGCGCCCTT CGCCCGACCA TCATGAGCAA AGAGATTCCC ACGCCTTACA TGTGGAGCTA
26461 CCAGCCCCAG ATGGGCCTGG CCGCCGGCGC CGCCCAGGAC TACTCCACCC GCATGAACTG
26521 GCTCAGTGCC GGGCCCGCGA TGATCTCACG GGTGAATGAC ATCCGCGCCC ACCGAAACCA
26581 GATACTCCTA GAACAGTCAG CGATCACCGC CACGCCCCGC CATCACCTTA ATCCGCGTAA
26641 TTGGCCCGCC GCCCTGGTGT ACCAGGAAAT TCCCCAGCCC ACGACCGTAC TACTTCCGCG
26701 AGACGCCCAG GCCGAAGTCC AGCTGACTAA CTCAGGTGTC CAGCTGGCCG GCGGCGCCGC
26761 CCTGTGTCGT CACCGCCCCG CTCAGGGTAT AAAGCGGCTG GTGATCCGAG GCAGAGGCAC
26821 ACAGCTCAAC GACGAGGTGG TGAGCTCTTC GCTGGGTCTG CGACCTGACG GAGTCTTCCA
26881 ACTCGCCGGA TCGGGGAGAT CTTCCTTCAC GCCTCGTCAG GCCGTCCTGA CTTTGGAGAG
26941 TTCGTCCTCG CAGCCCCGCT CGGGCGGCAT CGGCACTCTC CAGTTCGTGG AGGAGTTCAC
27001 TCCCTCGGTN TACTTCAACC CCTTCTCCGG CTCCCCCGGC CACTACCCGG ACGAGTTCAT
27061 CCCGAACTTC GACGCCATCA GCGAGTCGGT GGACGGCTAC GATTGAATGT CCCATGGTGG
27121 CGCAGCTGAC CTAGCTCGGC TTCGACACCT GGACCACTGC CGCCGCTTCC GCTGCTTCGC
27181 TCGGGATCTC GCCGAGTTTG CCTACTTTGA GCTGCCCGAG GAGCACCCTC AGGGCCCAGC
27241 CCACGGAGTG CGGATCATCG TCGAAGGGGG CCTCGACTCC CACCTGCTTC GGATCTTCAG
27301 CCAGCGACCG ATCCTGGTCG AGCGCGAACA AGGACAGACC CTTCTTACTT TGTACTGCAT
27361 CTGCAACCAC CCCGGCCTGC ATGAAAGTCT TTGTTGTCTG CTGTGTACTG AGTATAATAA
27421 AAGCTGAGAT CAGCGACTAC TCCGACTCG ATTGTGGTGT TCCTGCTATC AACCGGTCCC
27481 TGTTCTTCAC CGGGAACGAG ACCGAGCTCC AGCTCCAGTG TAAGCCCCAC AAGAAGTACC
27541 TCACCTGGCT GTTCCAGGGC TCCCCGATCG CCGTTGTCAA CCACTGCGAC AACGACGGAG
27601 TCCTGCTGAG CGGCCCTGCC AACCTTACTT TTTCCACCCG CAGAAGCAAG CTCCAGCTCT
27661 TCCAACCCTT CCTCCCCGGG ACCTATCAGT GCGTCTCAGG ACCCTGCCAT CACACCTTCC
27721 ACCTGATCCC GAATACCACA GCGCCGCTCC CCGCTACTAA CAACCAAACT ACCCACCAAC
27781 GCCACCGTCG CGACCTTTCC TCTGAATCTA ATACCACTAC GGAGGTGAG CTCCGAGGTC
```

FIG. 7H

```
27841 GACCAACCTC TGGGATTTAC TACGGCCCCT GGGAGGTGGT GGGGTTAATA GCGCTAGGCC
27901 TAGTTGCGGG TGGGCTTTTG GTTCTCTGCT ACCTATACCT CCCTTGCTGT TCGTACTTAG
27961 TGGTGCTGTG TTGCTGGTTT AAGAAATGGG GAAGATCACC CTAGTGAGCT GCGGTGCGCT
28021 GGTGGCGGTG TTGCTTTCGA TTGTGGGACT GGGCGGCGCG GCTGTAGTGA AGGAGAAGGC
28081 CGATCCCTGC TTGCATTTCA ATCCCAACAA ATGCCAGCTG AGTTTTCAGC CCGATGGCAA
28141 TCGGTGCGCG GTACTGATCA AGTGCGGATG GGAATGCGAG AACGTGAGAA TCGAGTACAA
28201 TAACAAGACT CGGAACAATA CTCTCGCGTC CGTGTGGCAG CCCGGGGACC CCGAGTGGTA
28261 CACCGTCTCT GTCCCCGGTG CTGACGGCTC CCCGCGCACC GTGAATAATA CTTTCATTTT
28321 TGCGCACATG TGCAACACGG TCATGTGGAT GAGCAAGCAG TACGATATGT GGCCCCCCAC
28381 GAAGGAGAAC ATCGTGGTCT TCTCCATCGC TTACAGCCTG TGCACGGCGC TAATCACCGC
28441 TATCGTGTGC CTGAGCATTC ACATGCTCAT CGCTATTCGC CCCAGAAATA ATGCCGAGAA
28501 AGAGAAACAG CCATAACACG TTTTTTCACA CACCTTGTTT TTACAGACAA TGCGTCTGTT
28561 AAATTTTTTA AACATTGTGC TCAGTATTGC TTATGCCTCT GGTTATGCAA ACATACAGAA
28621 AACCCTTTAT GTAGGATCTG ATGGTACACT AGAGNGTACC CAATCACAAG CCAAGGTTGC
28681 ATGGTATTTT TATAGAACCA ACACTGATCC AGTTAAACTT TGTAAGGGTG AATTGCCGCG
28741 TACACATAAA ACTCCACTTA CATTTAGTTG CAGCAATAAT AATCTTACAC TTTTTTCAAT
28801 TACAAAACAA TATACTGGTA CTTATTACAG TACAAACTTT CATACAGGAC AAGATAAATA
28861 TTATACTGTT AAGGTAGAAA ATCCTACCAC TCCTAGAACT ACCACCACCA CCACTACTGC
28921 AAAGCCCACT GTGAAAACTA CAACTAGGAC CACCACAACT ACAGAAACCA CCACCAGCAC
28981 AACACTTGCT GCAACTACAC ACACACACAC TAAGCTAACC TTACAGACCA CTAATGATTT
29041 GATCGCCCTG CTGCAAAAGG GGGATAACAG CACCACTTCC AATGAGGAGA TACCCAAATC
29101 CATGATTGGC ATTATTGTTG CTGTAGTGGT GTGCATGTTG ATCATCGCCT TGTGCATGGT
29161 GTACTATGCC TTCTGCTACA GAAAGCACAG ACTGAACGAC AAGCTGGAAC ACTTACTAAG
29221 TGTTGAATTT TAATTTTTTA GAACCATGAA GATCCTAGGC CTTTTTAGTT TTTCTATCAT
29281 TACCTCTGCT CTTTGTGAAT CAGTGGATAG AGATGTTACT ATTACCACTG GTTCTAATTA
29341 TACACTGAAA GGGCCACCCT CAGGTATGCT TTCGTGGTAT TGCTATTTTG GAACTGACAC
29401 TGATCAAACT GAATTATGCA ATTTTCAAAA AGGCAAAACC TCAAACTCTA AAATCTCTAA
29461 TTATCAATGC AATGGCACTG ATCTGATACT ACTCAATGTC ACGAAAGCAT ATGGTGGCAG
29521 TTATTATTGC CCTGGACAAA ACACTGAAGA AATGATTTTT TACAAAGTGG AAGTGGTTGA
29581 TCCCACTACA CCACCCACCA CCACAACTAT TCATACCACA CACACAGAAC AAACACCAGA
29641 GGCAACAGAA GCAGAGTTGG CCTTCCAGGT TCACGGAGAT TCCTTTGCTG TCAATACCCC
29701 TACACCCGAT CAGCGGTGTC CGGGGCCGCT AGTCAGCGGC ATTGTCGGTG TGCTTTCGGG
29761 ATTAGCAGTC ATAATCATCT GCATGTTCAT TTTTGCTTGC TGCTATAGAA GGCTTTACCG
29821 ACAAAAATCA GACCCACTGC TGAACCTCTA TGTTTAATTT TTTCCAGAGC CATGAAGGCA
29881 GTTAGCGCTC TAGTTTTTTG TTCTTTGATT GGCATTGTTT TTAATAGTAA AATTACCAGA
29941 GTTAGCTTTA TTAAACATGT TAATGTAACT GAAGGAGATA ACATCACACT AGCAGGTGTA
30001 GAAGGTGCTC AAAACACCAC CTGGACAAAA TACCATCTAG GATGGAGAGA TATTTGCACC
30061 TGGAATGTAA CTTATTATTG CATAGGAGTT AATCTTACCA TTGTTAACGC TAACCAATCT
30121 CAGAATGGGT TAATTAAAGG ACAGAGTGTT AGTGTGACCA GTGATGGGTA CTATACCCAG
30181 CATAGTTTTA ACTACAACAT TACTGTCATA CCACTGCCTA CGCCTAGCCC ACCTAGCACT
30241 ACCACACAGA CAACCACATA CAGTACATCA AATCAGCCTA CCACCACTAC AGCAGCAGAG
30301 GTTGCCAGCT CGTCTGGGGT CCGAGTGGCA TTTTTGATGT TGGCCCCATC TAGCAGTCCC
30361 ACTGCTAGTA CCAATGAGCA GACTACTGAA TTTTTGTCCA CTGTCGAGAG CCACACCACA
30421 GCTACCTCCA GTGCCTTCTC TAGCACCGCC AATCTCTCCT CGCTTTCCTC TACACCAATC
30481 AGCCCGCTA CTACTCCTAG CCCCGCTCCT CTTCCCACTC CCCTGAAGCA AACAGACGGC
30541 GGCATGCAAT GGCAGATCAC CCTGCTCATT GTGATCGGGT TGGTCATCCT GGCCGTGTTG
30601 CTCTACTACA TCTTCTGCCG CCGCATTCCC AACGCGCACC GCAAGCCGGC CTACAAGCCC
30661 ATCGTTATCG GGCAGCCGGA GCCGCTTCAG GTGGAAGGGG GTCTAAGGAA TCTTCTCTTC
30721 TCTTTTACAG TATGGTGATT GAANTATGAT TCCTAGACAA TTCTTGATCA CTATTCTTAT
30781 CTGCCTCCTC CAAGTCTGTG CCACCCTCGC TCTGGTGGCC AACGCCAGTC CAGACTGTAT
30841 TGGGCCCTTC GCCTCCTACG TGCTCTTTGC CTTCGTCACC TGCATCTGCT GCTGTAGCAT
30901 AGTCTGCCTG CTTATCACCT TCTTCCAGTT CATTGACTGG ATCTTTGTGC GCATCGCCTA
30961 CCTGCGCCAC CACCCCCAGT ACCGCGACCA GCGAGTGGCG CAGCTGCTCA GGCTCCTCTG
31021 ATAAGCATGC GGGCTCTGCT ACTTNTCGCG CTTCTGCTGT TAGTGCTCCC CCGTCCCGTC
31081 GACCCCGGT CCCCACTCA GTCCCCGAG GAGGTTCGCA AATGCAAATT CCAAGAACCC
31141 TGGAAATTCC TCAAATGCTA CCGCCAAAAA TCAGACATGC ATCCCAGCTG GATCATGATC
31201 ATTGGGATCG TGAACATTCT GGCCTGCACC CTCATCTCCT TTGTGATTTA CCCCTGCTTT
31261 GACTTTGGTT GGAACTCGCC AGAGGCGCTC TATCTCCCGC CTGAACCTGA CACACCACCA
```

FIG. 71

```
31321 CAGCATCAAC CTCAGGCACA CGCACTACCA CCACCACAGC CTAGGCCACA ATACATGCCC
31381 ATATTAGACT ATGAGGCCGA GCCACAGCGA CCCATGCTCC CCGCTATTAG TTACTTCAAT
31441 CTAACCGGCG GAGATGACTG ACCCACTGGC CAATAACAAC GTCAACGACC TTCTCCTGGA
31501 CATGGACGGC CGCGCCTCGG AGCAGCGACT CGCCCAACTT CGCATTCGTC AGCAGCAGGA
31561 GAGAGCCGTC AAGGAGCTGC AGGACGGCAT AGCCATCCAC CAGTGCAAGA GAGGCATCTT
31621 CTGCCTGGTG AAACAGGCCA AGATCTCCTA CGAGGTCACC CAGACCGACC ATCGCCTCTC
31681 CTACGAGCTC CTGCAGCAGC GCCAGAAGTT CACCTGCCTG GTCGGAGTCA ACCCCATCGT
31741 CATCACCCAG CCAGCAGTCG GGCGATACCA AGGGGTGCAT CCACTGCTCC TGCGACTCCC
31801 CCGACTGCGT CCACACTCTG ATCAAGACCC TCTGCGGCCT CCGCGACCTC CTCCCCATGA
31861 ACTAATCACC CCCTTATCCA GTGAAATAAA GATCATATTG ATGATGATTT AAATAAAAAA
31921 AATAATCATT TGATTTGAAA TAAAGATACA ATCATATTGA TGATTTGAGT TTAACAAAAA
31981 TAAAGAATCA CTTACTTGAA ATCTGATACC AGGTCTCTGT CCATGTTTTC TGCCAACACC
32041 ACCTCACTCC CCTCTTCCCA GCTCTGGTAC TGCAGGCCCC GGCGGGCTGC AAACTTCCTC
32101 CACACGCTGA AGGGGATGTC AAATTCCTCC TGTCCCTCAA TCTTCATTTT ATCTTCTATC
32161 AGATGTCCAA AAAGCGCGTC CGGGTGGATG ATGACTTCGA CCCCGTCTAC CCCTACGATG
32221 CAGACAACGC ACCGACCGTG CCCTTCATCA ACCCCCCCTT CGTCTCTTCA GATGGATTCC
32281 AAGAGAAGCC CCTGGGGGTG TTGTCCCTGC GACTGGCTGA CCCCGTCACC ACCAAGAACG
32341 GGGAAATCAC CCTCAAGCTG GGAGAGGGGG TGGACCTCGA CTCGTCGGGA AAACTCATCT
32401 CCAACACGGC CACCAAGGCC GCCGCCCCTC TCAGTATTTC AAACAACACC ATTTCCCTTA
32461 AAACTGCTGC CCCTTTCTAC AACAACAATG GAACTTTAAG CCTCAATGTC TCCACACCAT
32521 TAGCAGTATT TCCCACATTT AACACTTTAG GCATAAGTCT TGGAAACGGT CTTCAGACTT
32581 CAAATAAGTT GTTGACTGTA CAACTAACTC ATCCTCTTAC ATTCAGCTCA AATAGCATCA
32641 CAGTAAAAAC AGACAAAGGG CTATATATTA ACTCCAGTGG AAACAGAGGA CTTGAGGCTA
32701 ATATAAGCCT AAAAAGAGGA CTAGTTTTTG ACGGTAATGC TATTGCAACA TATATTGGAA
32761 ATGGCTTAGA CTATGGATCT TATGATAGTG ATGGAAAAAC AAGACCCGTA ATTACCAAAA
32821 TTGGAGCAGG ATTAAATTTT GATGCTAACA AAGCAATAGC TGTCAAACTA GGCACAGGTT
32881 TAAGTTTTGA CTCCGCTGGT GCCTTGACAG CTGGAAACAA ACAGGATGAC AAGCTAACAC
32941 TTTGGACTAC CCCTGACCCA AGCCCTAATT GTCAATTACT TTCAGACAGA GATGCCAAAT
33001 TTACTCTCTG TCTTACAAAA TGCGGTAGTC AAATACTAGG CACTGTGGCA GTGGCGGCTG
33061 TTACTGTAGG ATCAGCACTA AATCAATTA ATGACACAGT CAAAAGCGCC ATAGTTTTCC
33121 TTAGATTTGA TTCCGATGGT GTACTCATGT CAAACTCATC AATGGTAGGT GATTACTGGA
33181 ACTTTAGGGA GGGACAGACC ACTCAAAGTG TAGCCTATAC AAATGCTGTG GGATTCATGC
33241 CAAATATAGG TGCATATCCA AAAACCCAAA GTAAAACACC TAAAAATAGC ATAGTCAGTC
33301 AGGTATATTT AACTGGAGAA ACTACTATGC CAATGACACT AACCATAACT TTCAATGGCA
33361 CTGATGAAAA AGACACAACC CCAGTTAGCA CCTACTCTAT GACTTTTACA TGGCAGTGGA
33421 CTGGAGACTA TAAGGACAAA AATATTACCT TTGCTACCAA CTCATTCTCT TTTTCCTACA
33481 TCGCCCAGGA ATAATCCCAC CCAGCAAGCC AACCCCTTTT CCCACCACCT TTGTCTATAT
33541 GGAAACTCTG AAACAGAAAA ATAAAGTTCA AGTGTTTTAT TGAATCAACA GTTTTACAGG
33601 ACTCGAGCAG TTATTTTTCC TCCACCCTCC CAGGACATGG AATACACCAC CCTCTCCCCC
33661 CGCACAGCCT TGAACATCTG AATGCCATTG GTGATGGACA TGCTTTTGGT CTCCACGTTC
33721 CACACAGTTT CAGAGCGAGC CAGTCTCGGA TCGGTCAGGG AGATGAAACC CTCCGGGCAC
33781 TCCCGCATCT GCACCTCACA GCTCAACAGC TGAGGATTGT CCTCGGTGGT CGGGATCACG
33841 GTTATCTGGA AGAAGCAGAA GAGCGGCGGT GGGAATCATA GTCCGCGAAC GGGATCGGCC
33901 GGTGGTGTCG CATCAGGCCC CGCAGCAGTC GCTGCCGCCG CCGCTCCGTC AAGCTGCTGC
33961 TCAGGGGGTT CGGGTCCAGG GACTCCCTCA GCATGATGCC CACGGCCCTC AGCATCAGTC
34021 GTCTGGTGCG GCGGGCGCAG CAGCGCATGC GAATCTCGCT CAGGTCACTG CAGTACGTGC
34081 AACACAGGAC CACCAGGTTG TTCAACAGTC CATAGTTCAA CACGCTCCAG CCGAAACTCA
34141 TCGCGGGAAG GATGCTACCC ACGTGGCCGT CGTACCAGAT CCTCAGGTAA ATCAAGTGGC
34201 GCTCCCTCCA GAAGACGCTG CCCATGTACA TGATCTCCTT GGGCATGTGG CGGTTCACCA
34261 CCTCCCGGTA CCACATCACC CTCTGGTTGA ACATGCAGCC CCGGATGATC CTGCGGAACC
34321 ACAGGGCCAG CACCGCCCCG CCCGCCATGC AGCGAAGAGA CCCCGGATCC CGGCAATGAC
34381 AATGGAGGAC CCACCGCTCG TACCCGTGGA TCATCTGGGA GCTGAACAAG TCTATGTTGG
34441 CACAGCACAG GCATATGCTC ATGCATCTCT TCAGCACTCT CAGCTCCTCG GGGGTCAAAA
34501 CCATATCCCA GGGCACGGGG AACTCTTGCA GGACAGCGAA CCCCGCAGAA CAGGGCAATC
34561 CTCGCACATA ACTTACATTG TGCATGGACA GGGTATCGCA ATCAGGCAGC ACCGGGTGAT
34621 CCTCCACCAG AGAAGCGCGG GTCTCGGTCT CCTCACAGCG TGGTAAGGGG GCCGGCCGAT
34681 ACGGGTGATG GCGGGACGCG GCTGATCGTG TTCTCGACCG TGTCATGATG CAGTTGCTTT
34741 CGGACATTTT CGTACTTGCT GTAGCAGAAC CTGGTCCGGG CGCTGCACAC CGATCGCCGG
```

FIG. 7J

```
34801 CGGCGGTCTC GGCGCTTGGA ACGCTCGGTG TTAAAGTTGT AAAACAGCCA CTCTCTCAGA
34861 CCGTGCAGCA GATCTAGGGC CTCAGGAGTG ATGAAGATCC CATCATGCCT GATAGCTCTG
34921 ATCACATCGA CCACCGTGGA ATGGGCCAGG CCCAGCCAGA TGATGCAATT TTGTTGGGTT
34981 TCGGTGACGG CGGGGGAGGG AAGAACAGGA AGAACCATGA TTAACTTTTA ATCCAAACGG
35041 TCTCGGAGCA CTTCAAAATG AAGGTCACGG AGATGGCACC TCTCGCCCCC GCTGTGTTGG
35101 TGGAAAATAA CAGCCAGGTC AAAGGTGATA CGGTTCTCGA GATGTTCCAC GGTGGCTTCC
35161 AGCAAAGCCT CCACGCGCAC ATCAGAAACA AGACAATAGC GAAAGCGGGA GGGTTCTCTA
35221 ATTCCTCAAC CATCATGTTA CACTCCTGCA CCATCCCCAG ATAATTTTCA TTTTTCCAGC
35281 CTTGAATGAT TCGAACTAGT TCCTGAGGTA AATCCAAGCC AGCCATGATA AAAGCTCGC
35341 GCAGAGCACC CTCCACCGGC ATTCTTAAGC ACACCCTCAT AATTCCAAGA TATTCTGCTC
35401 CTGGTTCACC TGCAGCAGAT TGACAAGCGG AATATCAAAA TCTCTGCCGC GATCCCTGAG
35461 CTCCTCCCTC AGCAATAACT GTAAGTACTC TTTCATATCG TCTCCGAAAT TTTTAGCCAT
35521 AGGACCCCCA GGAATAAGAG AAGGGCAAGC CACATTACAG ATAAACCGAA GTCCCCCCCA
35581 GTGAGCATTG CCAAATGTAA GATTGAAATA AGCATGCTGG CTAGACCCGG TGATATCTTC
35641 CAGATAACTG GACAGAAAAT CGGGTAAGCA ATTTTTAAGA AAATCAACAA AGAAAAATC
35701 TTCCAGGTGC ACGTTAGGG CCTCGGGAAC AACGATGGAG TAAGTGCAAG GGGTGCGTTC
35761 CAGCATGGTT AGTTAGCTGA TCTGTAAAAA AACAAAAAAT AAAACATTAA ACCATGCTAG
35821 CCTGGCGAAC AGGTGGGTAA ATCGTTCTCT CCAGCACCAG GCAGGCACG GGGTCTCCGG
35881 CGCGACCCTC GTAAAAATTG TCGCTATGAT TGAAAACCAT CACAGAGAGA CGTTCCCGGT
35941 GGCCGGCGTG AATGATTCGA GAAGAAGCAT ACACCCCCG GAACATTGGA GTCCGTGAGT
36001 GAAAAAAGC GGCCGAGGAA GCAATGAGGC ACTACAACGC TCACTCTCAA GTCCAGCAAA
36061 GCGATGCCAT GCGGATGAAG CACAAAATTT TCAGGTGCGT AAAAAATGTA ATTACTCCCC
36121 TCCTGCACAG GCAGCGAAGC TCCCGATCCC TCCAGATACA CATACAAAGC CTCAGCGTCC
36181 ATAGCTTACC GAGCGGCAGC AGCAGCGGCA CACAACAGGC GCAAGAGTCA GAGAAAAGAC
36241 TGAGCTCTAA CCTGTCCGCC CGCTCTCTGC TCAATATATA GCCCCAGATC TACACTGACG
36301 TAAAGGCCAA AGTCTAAAAA TACCCGCCAA ATAATCACAC ACGCCCAGCA CACGCCCAGA
36361 AACCGGTGAC ACACTCAGAA AAATACGCGC ACTTCCTCAA ACGGCCAAAC TGCCGTCATT
36421 TCCGGGTTCC CACGCTACGT CATCAAAACA CGACTTTCAA ATTCCGTCGA CCGTTAAAAA
36481 CATCACCCGC CCCGCCCCTA ACGGTCGCCG CTCCCGCAGC CAATCACCTT CCTCCCTCCC
36541 CAAATTCAAA CAGCTCATTT GCATATTAAC GCGCACCAAA AGTTTGAGGT ATATTATTGA
36601 TGATGG    (SEQ ID NO: 3)
```

FIG. 7K

```
   1 CATCATCAAT AATATACCTC AAACTTTTGG TGCGCGTTAA TATGCAAATG AGCTGTTTGA
  61 ATTTGGGGAG GGAGGAAGGT GATTGGCCGA GAGACGGGCG ACCGTTAGGG GCGGGGCGGG
 121 TGACGTTTTG ATGACGTGGC CGTGAGGCGG AGCCGGTTTG CAAGTTCTCG TGGGAAAAGT
 181 GACGTCAAAC GAGGTGTGGT TTGAACACGG AAATACTCAA TTTTCCCGCG CTCTCTGACA
 241 GGAAATGAGG TGTTTCTGGG CGGATGCAAG TGAAAACGGG CCATTTTCGC GCGAAAACTG
 301 AATGAGGAAG TGAAAATCTG AGTAATTTCG CGTTTATGGC AGGGAGGAGT ATTTGCCGAG
 361 GGCCGAGTAG ACTTTGACCG ATTACGTGGG GGTTTCGATT ACCGTATTTT TCACCTAAAT
 421 TTCCGCGTAC GGTGTCAAAG TCCGGTGTTT TTACGTAGGC GTCAGCTGAT CGCCAGGGTA
 481 TTTAAACCTG CGCTCTCTAG TCAAGAGGCC ACTCTTGAGT GCCAGCGAGT AGAGTTTTCT
 541 CCTCCGCGCC GCGAGTCAGA TCTACACTTT GAAAGATGAG GCACCTGAGA GACCTGCCCG
 601 GTAATGTTTT CCTGGCTACT GGGAACGAGA TTCTGGAATT GGTGGTGGAC GCCATGATGG
 661 GTGGCGACCC TCCTGAGCCC CCTACCCCAT TTGAGGCGCC TTCGCTGTAC GATTTGTATG
 721 ATCTGGAGGT GGATGTGCCC GAGAACGACC CCAACGAGGA GGCGGTGAAT GATTTGTTTA
 781 GCGATGCCGC GCTGCTGGCT GCCGAGCAGG CTAATACGGA CTCTGGCTCA GACAGCGATT
 841 CCTCTCTCCA TACCCCGAGA CCCGGCAGAG GTGAGAAAAA GATCCCCGAG CTTAAAGGGG
 901 AAGAGCTCGA CCTGCGCTGC TATGAGGAAT GCTTGCCTCC GAGCGATGAT GAGGAGGACG
 961 AGGAGGCGAT TCGAGCTGCA TCGAACCAGG GAGTGAAAGC TGCGGGCGAA AGCTTTAGCC
1021 TGGACTGTCC TACTCTGCCC GGACACGGCT GTAAGTCTTG TGAATTTCAT CGCATGAATA
1081 CTGGAGATAA GAATGTGATG TGTGCCCTGT GCTATATGAG AGCTTACAAC CATTGTGTTT
1141 ACAGTAAGTG TGATTAACTT TAGTTGGGAA GGCAGAGGGT GACTGGGTGC TGACTGGTTT
1201 ATTTATGTAT ATGTTTTTTT ATGTGTAGGT CCCGTCTCTG ACGTAGATGA GACCCCCACT
1261 TCAGAGTGCA TTTCATCACC CCCAGAAATT GGCGAGGAAC CGCCCGAAGA TATTATTCAT
1321 AGACCAGTTG CAGTGAGAGT CACCGGGCGG AGAGCAGCTG TGGAGAGTTT GGATGACTTG
1381 CTACAGGGTG GGGATGAACC TTTGGACTTG TGTACCCGGA AACGCCCCAG GCACTAAGTG
1441 CCACACATGT GTGTTTACTT AAGGTGATGT CAGTATTTAT AGGGTGTGGA GTGCAATAAA
1501 ATCCGTGTTG ACTTTAAGTG CGTGGTTTAT GACTCAGGGG TGGGGACTGT GGGTATATAA
1561 GCAGGTGCAG ACCTGTGTGG TCAGTTCAGA GCAGGACTCA TGGAGATCTG GACGGTCTTG
1621 GAAGACTTTC ACCAGACTAG ACAGCTGCTA GAGAACTCAT CGGAGGGGGT CTCTTACCTG
1681 TGGAGATTCT GCTTCGGTGG GCCTCTAGCT AAGCTAGTCT ATAGGGCCAA ACAGGATTAT
1741 AAGGATCAAT TTGAGGATAT TTTGAGAGAG TGTCCTGGTA TTTTTGACTC TCTCAACTTG
1801 GGCCATCAGT CTCACTTTAA CCAGAGTATT CTGAGAGCCC TTGACTTTTC TACTCCTGGC
1861 AGAACTACCG CCGCGGTAGC CTTTTTTGCC TTTATCCTTG ACAAATGGAG TCAAGAAACC
1921 CATTTCAGCA GGGATTACCG TCTGGACTGC TTAGCAGTAG CTTTGTGGAG AACATGGAGG
1981 TGCCAGCGCC TGAATGCAAT CTCCGGCTAC TTGCCAGTAC AGCCGGTAGA CACGCTGAGG
2041 ATCCTGAGTC TCCAGTCACC CCAGGAACAC CAACGCCGCC AGCAGCCGCA GCAGGAGCAG
2101 CAGCAAGAGG AGGAGGAGGA TCGAGAAGAG AACCCGAGAG CCGGTCTGGA CCCTCCGGTG
2161 GCGGAGGAGG AGGAGTAGCT GACTTGTTTC CCGAGCTGCG CCGGGTGCTG ACTAGGTCTT
2221 CCAGTGGACG GGAGAGGGGG ATTAAGCGGG AGAGGCATGA GGAGACTAGC CACAGAACTG
2281 AACTGACTGT CAGTCTGATG AGCCGCAGGC GCCCAGAATC GGTGTGGTGG CATGAGGTTC
2341 AGTCGCAGGG GATAGATGAG GTCTCGGTGA TGCATGAGAA ATATTCCCTG GAACAAGTCA
2401 AGACTTGTTG GTTGGAGCCT GAGGATGATT GGGAGGTAGC CATCAGGAAT TATGCCAAGC
2461 TGGCTCTGAA GCCAGACAAG AAGTACAAGA TTACCAAACT GATTAATATC AGAAATTCCT
2521 GCTACATTTC AGGGAATGGG GCCGAGGTGG AGATCAGTAC CAGGAGAGG GTGGCCTTCA
2581 GATGTTGTAT GATGAATATG TACCCGGGGG TGGTGGGCAT GGAGGGAGTC ACCTTTATGA
2641 ACGCGAGGTT CAGGGGTGAT GGGTATAATG GGGTGGTCTT TATGGCCAAC ACCAAGCTGA
2701 CAGTGCACGG ATGCTCCTTC TTTGGGTTCA ATAACATGTG CATCGAGGCC TGGGGCAGTG
2761 TTTCAGTGAG GGGATGCAGC TTTTCAGCCA ACTGGATGGG GGTCGTGGGC AGAACCAAGA
2821 GCAAGGTGTC AGTGAAGAAA TGCCTGTTCG AGAGGTGCCA CCTGGGGGTG ATGAGCGAGG
2881 GCGAAGCCAA AGTCAAACAC TGCGCCTCTA CTGAGACGGG CTGCTTTGTG CTGATCAAGG
2941 GCAATGCCCA AGTCAAGCAT AACATGATCT GTGGGGCCTC GGATGAGCGC GGCTACCAGA
3001 TGCTGACCTG CGCCGGTGGG AACAGCCATA TGCTGGCCAC CGTGCATGTG ACCTCGCACC
3061 CCCGCAAGAC ATGGCCCGAG TTCGAGCACA ACGTCATGAC CCGATGCAAT GTGCACCTGG
3121 GGTCCCGCCG AGGCATGTTC ATGCCCTACC AGTGCAACAT GCAATTTGTG AAGGTGCTGC
3181 TGGAGCCCGA TGCCATGTCC AGAGTGAGCC TGACGGGGGT GTTTGACATG AATGTGGAGC
3241 TGTGGAAAAT TCTGAGATAT GATGAATCCA AGACCAGGTG CCGGGCCTGC GAATGCGGAG
3301 GCAAGCACGC CAGGCTTCAG CCCGTGTGTG TGGAGGTGAC GGAGGACCTG CGACCCGATC
3361 ATTTGGTGTT GTCCTGCAAC GGGACGGAGT TCGGCTCCAG CGGGGAAGAA TCTGACTAGA
3421 GTGAGTAGTG TTTGGGGGAG GTGGAGGGCT TGTATGAGGG GCAGAATGAC TAAAATCTGT
```

FIG. 8A

```
3481 GTTTTTCTGT GTGTTGCAGC AGCATGAGCG GAAGCGCCTC CTTTGAGGGA GGGGTATTCA
3541 GCCCTTATCT GACGGGGCGT CTCCCCTCCT GGGCGGGAGT GCGTCAGAAT GTGATGGGAT
3601 CCACGGTGGA CGGCCGGCCC GTGCAGCCCG CGAACTCTTC AACCCTGACC TACGCGACCC
3661 TGAGCTCCTC GTCCGTGGAC GCAGCTGCCG CCGCAGCTGC TGCTTCCGCC GCCAGCGCCG
3721 TGCGCGGAAT GGCCCTGGGC GCCGGCTACT ACAGCTCTCT GGTGGCCAAC TCGACTTCCA
3781 CCAATAATCC CGCCAGCCTG AACGAGGAGA AGCTGCTGCT GCTGATGGCC CAGCTCGAGG
3841 CCCTGACCCA GCGCCTGGGC GAGCTGACCC AGCAGGTGGC TCAGCTGCAG GCGGAGACGC
3901 GGGCCGCGGT TGCCACGGTG AAAACCAAAT AAAAAATGAA TCAATAAATA AACGGAGACG
3961 GTTGTTGATT TTAACACAGA GTCTTGAATC TTTATTTGAT TTTTCGCGCG CGGTAGGCCC
4021 TGGACCACCG GTCTCGATCA TTGAGCACCC GGTGGATTTT TTCCAGGACC CGGTAGAGGT
4081 GGGCTTGGAT GTTGAGGTAC ATGGGCATGA GCCCGTCCCG GGGGTGGAGG TAGCTCCATT
4141 GCAGGGCCTC GTGCTCGGGG GTGGTGTTGT AAATCACCCA GTCATAGCAG GGGCGCAGGG
4201 CGTGGTGCTG CACGATGTCC TTGAGGAGGA GACTGATGGC CACGGGCAGC CCCTTGGTGT
4261 AGGTGTTGAC GAACCTGTTG AGCTGGGAGG GATGCATGCG GGGGAGATG AGATGCATCT
4321 TGGCCTGGAT CTTGAGATTG GCGATGTTCC CGCCCAGATC CCGCCGGGGG TTCATGTTGT
4381 GCAGGACCAC CAGCACGGTG TATCCGGTGC ACTTGGGGAA TTTGTCATGC AACTTGGAAG
4441 GGAAGGCGTG AAAGAATTTG GAGACGCCCT TGTGACCGCC CAGGTTTTCC ATGCACTCAT
4501 CCATGATGAT GGCGATGGGC CCGTGGGCGG CGGCCTGGGC AAAGACGTTT CGGGGGTCGG
4561 ACACATCGTA GTTGTGGTCC TGGGTGAGCT CGTCATAGGC CATTTTAATG AATTTGGGGC
4621 GGAGGGTGCC CGACTGGGGG ACGAAGGTGC CCTCGATCCC GGGGGCGTAG TTGCCCTCGC
4681 AGATCTGCAT CTCCCAGGCC TTGAGCTCGG AGGGGGGGAT CATGTCCACC TGCGGGCGA
4741 TGAAAAAAAC GGTTTCCGGG GCGGGGAGA TGAGCTGGGC CGAAAGCAGG TTCCGGAGCA
4801 GCTGGGACTT GCCGCAGCCG GTGGGGCCGT AGATGACCCC GATGACCGGC TGCAGGTGGT
4861 AGTTGAGGGA GAGACAGCTG CCGTCCTCGC GGAGGAGGGG GGCCACCTCG TTCATCATCT
4921 CGCGCACATG CATGTTCTCG CGCACGAGTT CCGCCAGGAG GCGCTCGCCC CCAGCGAGA
4981 GGAGCTCTTG CAGCGAGGCG AAGTTTTTCA GCGGCTTGAG CCCGTCGGCC ATGGGCATTT
5041 TGGAGAGGGT CTGTTGCAAG AGTTCCAGAC GGTCCCAGAG CTCGGTGATG TGCTCTAGGG
5101 CATCTCGATC CAGCAGACCT CCTCGTTTCG CGGGTTGGGG CGACTGCGGG AGTAGGGCAC
5161 CAGGCGATGG GCGTCCAGCG AGGCCAGGGT CCGGTCCTTC CAGGGTCGCA GGGTCCGCGT
5221 CAGCGTGGTC TCCGTCACGG TGAAGGGGTG CGCGCCGGGC TGGGCGCTTG CGAGGGTGCG
5281 CTTCAGGCTC ATCCGGCTGG TCGAGAACCG CTCCCGGTCG GCGCCCTGCG CGTCGGCCAG
5341 GTAGCAATTG AGCATGAGTT CGTAGTTGAG CGCCTCGGCC GCGTGGCCCT TGGCGCGGAG
5401 CTTACCTTTG GAAGTGTGTC CGCAGACGGG ACAGAGGAGG GACTTGAGGG CGTAGAGCTT
5461 GGGGGCGAGG AAGACGGACT CGGGGGCGTA GGCGTCCGCG CCGCAGCTGG CGCAGACGGT
5521 CTCGCACTCC ACGAGCCAGG TGAGGTCGGG CCGGTTGGGG TCAAAAACGA GGTTTCCTCC
5581 GTGCTTTTTG ATGCGTTTCT TACCTCTGGT CTCCATGAGC TCGTGTCCCC GCTGGGTGAC
5641 AAAGAGGCTG TCCGTGTCCC CGTAGACCGA CTTTATGGGC CGGTCCTCGA GCGGGGTGCC
5701 GCGGTCCTCG TCGTAGAGGA ACCCCGCCCA CTCCGAGACG AAGGCCCGGG TCCAGGCCAG
5761 CACGAAGGAG GCCACGTGGG AGGGGTAGCG GTCGTTGTCC ACCAGCGGGT CCACCTTCTC
5821 CAGGGTATGC AAGCACATGT CCCCCTCGTC CACATCCAGG AAGGTGATTG GCTTGTAAGT
5881 GTAGGCCACG TGACCGGGGG TCCCGGCCGG GGGGGTATAA AAGGGGGCGG GCCCCTGCTC
5941 GTCCTCACTG TCTTCCGGAT CGCTGTCCAG GAGCGCCAGC TGTTGGGGTA GGTATTCCCT
6001 CTCGAAGGCT GGCATAACCT CGGCACTCAG GTTGTCAGTT TCTAGAAACG AGGAGGATTT
6061 GATATTGACG GTGCCGTTGG AGACGCCTTT CATGAGCCCC TCGTCCATCT GGTCAGAAAA
6121 GACGATCTTT TTGTTGTCGA GCTTGGTGGC GAAGGAGCCG TAGAGGGCGT TGGAGAGGAG
6181 CTTGGCGATG GAGCGCATGG TCTGGTTCTT TTCCTTGTCG GCGCGCTCCT TGGCGGCGAT
6241 GTTGAGCTGC ACGTACTCGC GCGCCACGCA CTTCCATTCG GGGAAGACGG TGGTGAGCTC
6301 GTCGGGCACG ATTCTGACCC GCCAGCCGCG GTTGTGCAGG GTGATGAGGT CCACGCTGGT
6361 GGCCACCTCG CCGCGCAGGG GCTCGTTGGT CCAGCAGAGG CGCCCGCCCT TGCGCGAGCA
6421 GAAGGGGGGC AGCGGGTCCA GCATGAGCTC GTCGGGGGGG TCGGCGTCCA CGGTGAAGAT
6481 GCCGGGCAGA AGCTCGGGGT CGAAGTAGCT GATGCAGGTG TCCAGATCGT CCAGCGCCGC
6541 TTGCCAGTCG CGCACGGCCA GCGCGCGCTC GTAGGGGCTG AGGGGCGTGC CCCAGGGCAT
6601 GGGGTGCGTG AGCGCGGAGG CGTACATGCC GCAGATGTCG TAGACGTAGA GGGGCTCCTC
6661 GAGGACGCCG ATGTAGGTGG GGTAGCAGCG CCCCCGCGG ATGCTGGCGC GCACGTAGTC
6721 GTACAGCTCG TGCGAGGGCG CGAGGAGCCC CGTGCCGAGG TTGGAGCGTT GCGGCTTTTC
6781 GGCGCGGTAG ACGATCTGGC GGAAGATGGC GTGGGAGTTG GAGGAGATGG TGGGCCTCTG
6841 GAAGATGTTG AAGTGGGCGT GGGGCAGGCC GACCGAGTCC CTGATGAAGT GGGCGTAGGA
6901 GTCCTGCAGC TTGGCGACGA GCTCGGCGGT GACGAGGACG TCCAGGGCGC AGTAGTCGAG
```

FIG. 8B

```
6961  GGTCTCTTGG ATGATGTCGT ACTTGAGCTG GCCCTTCTGC TTCCACAGCT CGCGGTTGAG
7021  AAGGAACTCT TCGCGGTCCT TCCAGTACTC TTCGAGGGGG AACCCGTCCT GATCGGCACG
7081  GTAAGAGCCC ACCATGTAGA ACTGGTTGAC GGCCTTGTAG GCGCAGCAGC CCTTCTCCAC
7141  GGGGAGGGCG TAAGCTTGTG CGGCCTTGCG CAGGGAGGTG TGGGTGAGGG CGAAGGTGTC
7201  GCGCACCATG ACCTTGAGGA ACTGGTGCTT GAAGTCGAGG TCGTCGCAGC CGCCCTGCTC
7261  CCAGAGCTGG AAGTCCGTGC GCTTCTTGTA GGCGGGGTTG GGCAAAGCGA AAGTAACATC
7321  GTTGAAGAGG ATCTTGCCCG CGCGGGGCAT GAAGTTGCGA GTGATGCGGA AAGGCTGGGG
7381  CACCTCGGCC CGGTTGTTGA TGACCTGGGC GGCGAGGACG ATCTCGTCGA AGCCGTTGAT
7441  GTTGTGCCCG ACGATGTAGA GTTCCACGAA TCGCGGGCGG CCCTTAACGT GGGGCAGCTT
7501  CTTGAGCTCG TCGTAGGTGA GCTCGGCGGG GTCGCTGAGC CCGTGCTGCT CGAGGGCCCA
7561  GTCGGCGACG TGGGGGTTGG CGCTGAGGAA GGAAGTCCAG AGATCCACGG CCAGGGCGGT
7621  CTGCAAGCGG TCCCGGTACT GACGGAACTG CTGGCCCACG GCCATTTTTT CGGGGGTGAC
7681  GCAGTAGAAG GTGCGGGGGT CGCCGTGCCA GCGGTCCCAC TTGAGCTGGA GGGCGAGGTC
7741  GTGGGCGAGC TCGACGAGCG GCGGGTCCCC GGAGAGTTTC ATGACCAGCA TGAAGGGGAC
7801  GAGCTGCTTG CCGAAGGACC CCATCCAGGT GTAGGTTTCC ACATCGTAGG TGAGGAAGAG
7861  CCTTTCGGTG CGAGGATGCG AGCCGATGGG GAAGAACTGG ATCTCCTGCC ACCAGTTGGA
7921  GGAATGGCTG TTGATGTGAT GGAAGTAGAA ATGCCGACGG CGCGCCGAGC ACTCGTGCTT
7981  GTGTTTATAC AAGCGTCCGC AGTGCTCGCA ACGCTGCACG GGATGCACGT GCTGCACGAG
8041  CTGTACCTGG GTTCCTTTGA CGAGGAATTT CAGTGGGCAG TGGAGCGCTG GCGGCTGCAT
8101  CTGGTGCTGT ACTACGTCCT GGCCATCGGC GTGGCCATCG TCTGCCTCGA TGGTGGTCAT
8161  GCTGACGAGC CCGCGCGGGA GGCAGGTCCA GACTTCGGCT CGGACGGGTC GGAGAGCGAG
8221  GACGAGGGCG CGCAGGCCGG AGCTGTCCAG GGTCCTGAGA CGCTGCGGAG TCAGGTCAGT
8281  GGGCAGCGGC GGCGCGCGGT TGACTTGCAG GAGCTTTTCC AGGGCGCGCG GGAGGTCCAG
8341  ATGGTACTTG ATCTCCACGG CGCCGTTGGT GGCGACGTCC ACGGCTTGCA GGGTCCCGTG
8401  CCCCTGGGGC GCCACCACCG TGCCCCGTTT CTTCTTGGGC GCTGCTTCCA TGCCGGTCAG
8461  AAGCGGCGGC GAGGACGCGC GCCGGGCGGC AGGGCGGCT CGGGACCCGG AGGCAGGGC
8521  GGCAGGGGCA CGTCGGCGCC GCGCGCGGGC AGGTTCTGGT ACTGCGCCCG GAGAAGACTG
8581  GCGTGAGCGA CGACGCGACG GTTGACGTCC TGGATCTGAC GCCTCTGGGT GAAGGCCACG
8641  GGACCCGTGA GTTTGAACCT GAAAGAGAGT TCGACAGAAT CAATCTCGGT ATCGTTGACG
8701  GCGGCCTGCC GCAGGATCTC TTGCACGTCG CCCGAGTTGT CCTGGTAGGC GATCTCGGTC
8761  ATGAACTGCT CGATCTCCTC CTCCTGAAGG TCTCCGCGG CGGCGCGCTC GACGGTGGCC
8821  GCGAGGTCGT TGGAGATGCG GCCCATGAGC TGCGAGAAGG CGTTCATGCC GGCCTCGTTC
8881  CAGACGCGGC TGTAGACCAC GGCTCCGTCG GGTCGCGCG CGCGCATGAC CACCTCGGGCG
8941  AGGTTGAGCT CGACGTGGCG CGTGAAGACC GCGTAGTTGC AGAGGCGCTG GTAGAGGTAG
9001  TTGAGCGTGG TGGCGATGTG CTCGGTGACG AAGAAGTACA TGATCCAGCG GCGGAGCGGC
9061  ATCTCGCTGA CGTCGCCCAG GGCTTCCAAG CGCTCCATGG CCTCGTAGAA GTCCACGGCG
9121  AAGTTGAAAA ACTGGGAGTT GCGCGCCGAG ACGGTCAACT CCTCCTCCAG AAGACGGATG
9181  AGCTCAGCGA TGGTGGCGCG CACCTCGCGC TCGAAGGCCC GGGGGGCTC CTCTTCTTCC
9241  ATCTCTTCCT CCTCCACTAA CATCTCTTCT ACTTCCTCCT CAGGAGGCGG CGGCGGGGCA
9301  GGGGCCCTGC GTCGCCGGCG GCGCACGGGC AGACGGTCGA TGAAGCGCTC GATGGTCTCC
9361  CCGCGCCGGC GACGCATGGT CTCGGTGACG GCGCGCCCGT CCTCGCGGGG CCGCAGCGTG
9421  AAGACGCCGC CGCGCATCTC CAGGTGGCCG CCGGGGGGGT CTCCGTTGGG CAGGGAGAGG
9481  GCGCTGACGA TGCATCTTAT CAATTGGCCC GTAGGGACTC CGCGCAAGGA CCTGAGCGTC
9541  TCGAGATCCA CGGGATCCGA AAACCGCTGA ACGAAGGCTT CGAGCCAGTC GCAGTCGCAA
9601  GGTAGGCTGA GCCCGGTTTC TTGTTCTTCG GGGATTTCGG GAGGCGGGCG GCGATGCTG
9661  CTGGTGATGA AGTTGAAGTA GGCGGTCCTG AGACGGCGGA TGGTGGCGAG GAGCACCAGG
9721  TCCTTGGGCC CGGCTTGCTG GATGCGCAGA CGGTCGGCCA TGCCCCAGGC GTGGTCCTGA
9781  CACCTGGCGA GGTCCTTGTA GTAGTCCTGC ATGAGCCGCT CCACGGGCAC CTCCTCCTCG
9841  CCCGCGCGGC CGTGCATGCG CGTGAGCCCG AACCCGCGCT GGGGCTGGAC GAGCGCCAGG
9901  TCGGCGACGA CGCGCTCGGC GAGGATGGCC TGCTGTATCT GGGTGAGGGT GGTCTGGAAG
9961  TCGTCGAAGT CGACGAAGCG GTGGTAGGCT CCGGTGTTGA TGGTATAGGA GCAGTTGGCC
10021 ATGACGGACC AGTTGACGGT CTGGTGGCCG GGTCGCACGA GCTCGTGGTA CTTGAGGCGC
10081 GAGTAGGCGC GCGTGTCGAA GATGTAGTCG TTGCAGGTGC GCACGAGGTA CTGGTATCCG
10141 ACGAGGAAGT GCGGCGGCGG CTGGCGGTAG AGCGGCCATC GCTCGGTGGC GGGGGCGCCG
10201 GGCGCGAGGT CCTCGAGCAT GAGGCGGTGG TAGCCGTAGA TGTACCTGGA CATCCAGGTG
10261 ATGCCGGCGG CGGTGGTGGA GGCGCGCGGG AACTCGCGGA CGCGGTTCCA GATGTTGCGC
10321 AGCGGCAGGA AGTAGTTCAT GGTGGCCGCG TCTGGCCCG TGAGGCGCGC GCAGTCGTGG
10381 ATGCTCTAGA CATACGGGCA AAAACGAAAG CGGTCAGCGG CTCGACTCCG TGGCCTGGAG
```

FIG. 8C

```
10441 GCTAAGCGAA CGGGTTGGGC TGCGCGTGTA CCCCGGTTCG AATCTCGAAT CAGGCTGGAG
10501 CCGCAGCTAA CGTGGTACTG GCACTCCCGT CTCGACCCAA GCCTGCTAAC GAAACCTCCA
10561 GGATACGGAG GCGGGTCGTT TTTTGGCCTT GGTCGCTGGT CATGAAAAAC TAGTAAGCGC
10621 GGAAAGCGAC CGCCCGCGAT GGCTCGCTGC CGTAGTCTGG AGAAAGAATC GCCAGGGTTG
10681 CGTTGCGGTG TGCCCCGGTT CGAGCCTCAG CGCTCGGCGC CGGCCGGATT CCGCGGCTAA
10741 CGTGGGCGTG GCTGCCCCGT CGTTTCCAAG ACCCCTTAGC CAGCCGACTT CTCCAGTTAC
10801 GGAGCGAGCC CCTCTTTTTC TTGTGTTTTT GCCAGATGCA TCCCGTACTG CGGCAGATGC
10861 GCCCCCACCC TCCACCTCAA CCGCCCCTAC CGCCGCAGCA GCAGCAACAG CCGGCGCTTC
10921 TGCCCCCGCC CCAGCAGCAG CCAGCCACTA CCGCGGCGGC CGCCGTGAGC GGAGCCGGCG
10981 TTCAGTATGA CCTGGCCTTG GAAGAGGGCG AGGGGCTGGC GCGGCTGGGG GCGTCGTCGC
11041 CGGAGCGGCA CCCGCGCGTG CAGATGAAAA GGGACGCTCG CGAGGCCTAC GTGCCCAAGC
11101 AGAACCTGTT CAGAGACAGG AGCGGCGAGG AGCCCGAGGA GATGCGCGCC TCCCGCTTCC
11161 ACGCGGGGCG GGAGCTGCGG CGCGGCCTGG ACCGAAAGCG GGTGCTGAGG GACGAGGATT
11221 TCGAGGCGGA CGAGCTGACG GGGATCAGCC CCGCGCGCGC GCACGTGGCC GCGGCCAACC
11281 TGGTCACGGC GTACGAGCAG ACCGTGAAGG AGGAGAGCAA CTTCCAAAAA TCCTTCAACA
11341 ACCACGTGCG CACGCTGATC GCGCGCGAGG AGGTGACCCT GGGCCTGATG CACCTGTGGG
11401 ACCTGCTGGA GGCCATCGTG CAGAACCCCA CGAGCAAGCC GCTGACGGCG CAGCTGTTTC
11461 TGGTGGTGCA GCACAGTCGG GACAACGAGA CGTTCAGGGA GGCGCTGCTG AATATCACCG
11521 AGCCCGAGGG CCGCTGGCTC CTGGACCTGG TGAACATTCT GCAGAGCATC GTGGTGCAGG
11581 AGCGCGGGCT GCCGCTGTCC GAGAAGCTGG CGGCTATCAA CTTCTCGGTG CTGAGCCTGG
11641 GCAAGTACTA CGCTAGGAAG ATCTACAAGA CCCCGTACGT GCCCATAGAC AAGGAGGTGA
11701 AGATCGACGG GTTTTACATG CGCATGACCC TGAAAGTGCT GACCCTGAGC GACGATCTGG
11761 GGGTGTACCG CAACGACAGG ATGCACCGCG CGGTGAGCGC CAGCCGCCGG CGCGAGCTGA
11821 GCGACCAGGA GCTGATGCAC AGCCTGCAGC GGGCCCTGAC CGGGGCCGGG ACCGAGGGGG
11881 AGAGCTACTT TGACATGGGC GCGGACCTGC GCTGGCAGCC CAGCCGCCGG GCCTTGGAAG
11941 CTGCCGGCGG TTCCCCCTAC GTGGAGGAGG TGGACGATGA GGAGGAGGAG GGCGAGTACC
12001 TGGAAGACTG ATGGCGCGAC CGTATTTTTG CTAGATGCAG CAACAGCCAC CGCCTCCTGA
12061 TCCCGCGATG CGGGCGGCGC TGCAGAGCCA GCCGTCCGGC ATTAACTCCT CGGACGATTG
12121 GACCCAGGCC ATGCAACGCA TCATGGCGCT GACGACCCGC AATCCCGAAG CCTTTAGACA
12181 GCAGCCTCAG GCCAACCGGC TCTCGGCCAT CCTGGAGGCC GTGGTGCCCT CGCGCTCGAA
12241 CCCCACGCAC GAGAAGGTGC TGGCCATCGT GAACGCGCTG GTGGAGAACA AGGCCATCCG
12301 CGGCGACGAG GCCGGGCTGG TGTACAACGC GCTGCTGGAG CGCGTGGCCC GCTACAACAG
12361 CACCAACGTG CAGACGAACC TGGACCGCAT GGTGACCGAC GTGCGCGAGG CGGTGTCGCA
12421 GCGCGAGCGG TTCCACCGCG AGTCGAACCT GGGCTCCATG GTGGCGCTGA ACGCCTTCCT
12481 GAGCACGCAG CCCGCCAACG TGCCCGGGG CCAGGAGGAC TACACCAACT TCATCAGCGC
12541 GCTGCGGCTG ATGGTGGCCG AGGTGCCCCA GAGCGAGGTG TACCAGTCGG GCCGGACTA
12601 CTTCTTCCAG ACCAGTCGCC AGGGCTTGCA GACCGTGAAC CTGAGCCAGG CTTTCAAGAA
12661 CTTGCAGGGA CTGTGGGGCG TGCAGGCCCC GGTCGGGGAC CGCGCGACGG TGTCGAGCCT
12721 GCTGACGCCG AACTCGCGCC TGCTGCTGCT GCTGGTGGCG CCCTTCACGG ACAGCGGCAG
12781 CGTGAGCCGC GACTCGTACC TGGGCTACCT GCTTAACCTG TACGCGAGG CCATCGGGCA
12841 GGCGCACGTG GACGAGCAGA CCTACCAGGA GATCACCCAC GTGAGCCGCG CGCTGGGCCA
12901 GGAGGACCCG GGCAACCTGG AGGCCACCCT GAACTTCCTG CTGACCAACC GGTCGCAGAA
12961 GATCCCGCCC CAGTACGCGC TGAGCACCGA GGAGGAGCGC ATCCTGCGCT ACGTGCAGCA
13021 GAGCGTGGGG CTGTTCCTGA TGCAGGAGGG GGCCACGCCC AGCCGCCGCC TCGACATGAC
13081 CGCGCGCAAC ATGGAGCCCA GCATGTACGC TCGCAACCGC CCGTTCATCA ATAAGCTGAT
13141 GGACTACTTG CATCGGGCGG CCGCCATGAA CTCGGACTAC TTTACCAACG CCATCTTGAA
13201 CCCGCACTGG CTCCCGCCCC CGGGTTCTA CACGGGCGAG TACGACATGC CGACCCCAA
13261 CGACGGGTTC CTGTGCGGAC ACGTGGACAG CAGCGTGTTC TCGCCGCGCC CCGCCACCAC
13321 CGTGTGGAAG AAAGACGGGCG GGGACCGGCG GCCGTCCTCG CGCGCTGTCCG GTCGCGCGGG
13381 TGCTGCCGCG GCGGTGCCTG AGGCCGCCAG CCCCTTCCCG AGCCTGCCCT TTTCGCTGAA
13441 CAGCGTGCGC AGCAGCGAGC TGGGTCGGCT GACGCGGCCG CGCCTGCTGG CGAGGAGGA
13501 GTACCTGAAC GACTCCTTGT TGAGGCCCGA GCGCGAGAAG AACTTCCCCA ATAACGGGAT
13561 AGAGAGCCTG GTGGACAAGA TGAGCCGCTG GAAGACGTAC GCGCACGAGC ACAGGGACGA
13621 GCCCCGAGCT AGCAGCAGCG CAGGCACCCG TAGACGCCAG CGACACGACA GGCAGCGGGG
13681 TCTGGTGTGG GACGATGAGG ATTCCGCCGA CGACAGCAGC GTGTTGGACT TGGGTGGGAG
13741 TGGTGGTGGT AACCCGTTCG CTCACTTGCG CCCCCGTATC GGGCGCCTGA TGTAAGAATC
13801 TGAAAAAATA AAAACGGTA CTCACCAAGG CCATGGCGAC CAGCGTGCGT TCTTCTCTGT
13861 TGTTTGTAGT AGTATGATGA GGCGCGTGTA CCCGGAGGGT CCTCCTCCCT CGTACGAGAG
```

FIG. 8D

```
13921 CGTGATGCAG CAGGCGGTGG CGGCGGCGAT GCAGCCCCCG CTGGAGGCGC CTTACGTGCC
13981 CCCGCGGTAC CTGGCGCCTA CGGAGGGGCG GAACAGCATT CGTTACTCGG AGCTGGCACC
14041 CTTGTACGAT ACCACCCGGT TGTACCTGGT GGACAACAAG TCGGCGGACA TCGCCTCGCT
14101 GAACTACCAG AACGACCACA GCAACTTCCT GACCACCGTG GTGCAGAACA ACGATTTCAC
14161 CCCCACGGAG GCCAGCACCC AGACCATCAA CTTTGACGAG CGCTCGCGGT GGGGCGGCCA
14221 GCTGAAAACC ATCATGCACA CCAACATGCC CAACGTGAAC GAGTTCATGT ACAGCAACAA
14281 GTTCAAGGCG CGGGTGATGG TCTCGCGCAA GACCCCCAAT GGGGTCGCGG TGGATGAGAA
14341 TTATGATGGT AGTCAGGACG AGCTGACTTA CGAGTGGGTG GAGTTTGAGC TGCCCGAGGG
14401 CAACTTCTCG GTGACCATGA CCATCGATCT GATGAACAAC GCCATCATCG ACAACTACTT
14461 GGCGGTGGGG CGTCAGAACG GGGTGCTGGA GAGCGACATC GGCGTGAAGT TCGACACGCG
14521 CAACTTCCGG CTGGGCTGGG ACCCCGTGAC CGAGCTGGTG ATGCCGGGCG TGTACACCAA
14581 CGAGGCCTTC CACCCCGACA TCGTCCTGCT GCCCGGCTGC GGCGTGGACT TCACCGAGAG
14641 CCGCCTCAGC AACCTGCTGG GCATCCGCAA GCGGCAGCCC TTCAGGAGG GCTTCCAGAT
14701 CCTGTACGAG GACCTGGAGG GGGCAACAT CCCCGCGCTC TTGGATGTCG AAGCCTATGA
14761 GAAAAGCAAG GAGGAGGCCG CCGCAGCGGC GACCGCAGCC GTGGCCACCG CCTCTACCGA
14821 GGTGCGGGGC GATAATTTTG CTAGCGCCGC GGCAGTGGCC GAGGCGGCTG AAACCGAAAG
14881 TAAGATAGTC ATCCAGCCGG TGGAGAAGGA CAGCAAGGAC AGGAGCTACA ACGTGCTCGC
14941 GGACAAGAAA AACACCGCCT ACCGCAGCTG GTACCTGGCC TACAACTACG GCGACCCCGA
15001 GAAGGGCGTG CGCTCCTGGA CGCTGCTCAC CACCTCGGAC GTCACCTGCG GCGTGGAGCA
15061 AGTCTACTGG TCGCTGCCCG ACATGATGCA AGACCCGGTC ACCTTCCGCT CCACGCGTCA
15121 AGTTAGCAAC TACCCGGTGG TGGGCGCCGA GCTCCTGCCC GTCTACTCCA AGAGCTTCTT
15181 CAACGAGCAG GCCGTCTACT CGCAGCAGCT GCGCGCCTTC ACCTCGCTCA CGCACGTCTT
15241 CAACCGCTTC CCCGAGAACC AGATCCTCGT CCGCCCGCCC GCGCCCACCA TTACCACCGT
15301 CAGTGAAAAC GTTCCTGCTC TCACAGATCA CGGGACCCTG CCGCTGCGCA GCAGTATCCG
15361 GGGAGTCCAG CGCGTGACCG TCACTGACGC CAGACGCCGC ACCTGCCCCT ACGTCTACAA
15421 GGCCCTGGGC GTAGTCGCGC CGCGCGTCCT CTCGAGCCGC ACCTTCTAAA AATGTCCAT
15481 TCTCATCTCG CCCAGTAATA ACACCGGTTG GGGCCTGCGC GCGCCCAGCA AGATGTACGG
15541 AGGCGCTCGC CAACGCTCCA CGCAACACCC CGTGCGCGTG CGCGGGCACT TCCGCGCTCC
15601 CTGGGGCGCC CTCAAGGGCC GCGTGCGCTC GCGCACCACC GTCGACGACG TGATCGACCA
15661 GGTGGTGGCC GACGCGCGCA ACTACACGCC CGCCGCCGCG CCCGCCTCCA CCGTGGACGC
15721 CGTCATCGAC AGCGTGGTGG CCGATGCGCG CCGGTACGCC CGCGCCAAGA GCCGGCGGCG
15781 GCGCATCGCC CGGCGGCACC GGAGCACCCC CGCCATGCGC GCGGCGCGAG CCTTGCTGCG
15841 CAGGGCCAGG CGCACGGGAC GCAGGGCCAT GCTCAGGGCG GCCAGACGCG CGGCCTCCGG
15901 CAGCAGCAGC GCCGGCAGGA CCCGCAGACG CGCGGCCACG GCGGCGGCGG CGGCCATCGC
15961 CAGCATGTCC CGCCCGCGGC GCGGCAACGT GTACTGGGTG CGCGACGCCG CCACCGGTGT
16021 GCGCGTGCCC GTGCGCACCC GCCCCCCTCG CACTTGAAGA TGCTGACTTC GCGATGTTGA
16081 TGTGTCCCAG CGGCGAGGAG GATGTCCAAG CGCAAATACA AGGAAGAGAT GCTCCAGGTC
16141 ATCGCGCCTG AGATCTACGG CCCCGCGGTG AAGGAGGAAA GAAAGCCCCG CAAACTGAAG
16201 CGGGTCAAAA AGGACAAAAA GGAGGAGGAA GATGTGGACG GACTGGTGGA GTTTGTGCGC
16261 GAGTTCGCCC CCCGGCGGCG CGTGCAGTGG CGCGGGCGGA AAGTGAAACC GGTGCTGCGG
16321 CCCGGCACCA CGGTGGTCTT CACGCCCGGC GAGCGTTCCG GCTCCGCCTC CAAGCGCTCC
16381 TACGACGAGG TGTACGGGGA CGAGGACATC CTCGAGCAGG CGGTCGAGCG TCTGGGCGAG
16441 TTTGCTTACG GCAAGCGCAG CCGCCCCGCG CCCTTGAAAG AGGAGGCGGT GTCCATCCCG
16501 CTGGACCACG GCAACCCCAC GCCGAGCCTG AAGCCGGTGA CCCTGCAGCA GGTGCTGCCG
16561 AGCGCGGCGC CGCGCCGGGG CTTCAAGCGC GAGGGCGGCG AGGATCTGTA CCCGACCATG
16621 CAGCTGATGG TGCCCAAGCG CCAGAAGCTG GAGGACGTGC TGGAGCACAT GAAGGTGGAC
16681 CCCGAGGTGC AGCCCGAGGT CAAGGTGCGG CCCATCAAGC AGGTGGCCCC GGGCCTGGGC
16741 GTGCAGACCG TGGACATCAA GATCCCCACG GAGCCCATGG AAACGCAGAC CGAGCCCGTG
16801 AAGCCCAGCA CCAGCACCAT GGAGGTGCAG ACGGATCCCT GGATGCCGGC GCCGGCTTCC
16861 ACCACTCGCC GAAGACGCAA GTACGGCGCG GCCAGCCTGC TGATGCCCAA CTACGCGCTG
16921 CATCCTTCCA TCATCCCCAC GCCGGGCTAC CGCGGCACGC GCTTCTACCG CGGCTACACC
16981 AGCAGCCGCC GCAAGACCAC CACCCGCCGC CGCGTCGTC GCACCCGCCG CAGCAGCACC
17041 GCGACTTCCG CCGCCGCCCT GGTGCGGAGA GTGTACCGCA GCGGGCGCGA GCCTCTGACC
17101 CTGCCGCGCG CGCGCTACCA CCCGAGCATC GCCATTTAAC TCTGCCGTCG CCTCCTACTT
17161 GCAGATATGG CCCTCACATG CCGCCTCCGC GTCCCCATTA CGGGCTACCG AGGAAGAAAG
17221 CCGCGCCGTA GAAGGCTGAC GGGGAACGGG CTGCGTCGCC ATCACCACCG GCGGCGGCGC
17281 GCCATCAGCA AGCGGTTGGG GGGAGGCTTC CTGCCCGCGC TGATCCCCAT CATCGCCGCG
17341 GCGATCGGGG CGATCCCCGG CATAGCTTCC GTGGCGGTGC AGGCCTCTCA GCGCCACTGA
```

FIG. 8E

```
17401 GACACAGCTT GGAAAATTTG TAATAAAAAA ATGGACTGAC GCTCCTGGTC CTGTGATGTG
17461 TGTTTTTAGA TGGAAGACAT CAATTTTTCG TCCCTGGCAC CGCGACACGG CACGCGGCCG
17521 TTTATGGGCA CCTGGAGCGA CATCGGCAAC AGCCAACTGA ACGGGGGCGC CTTCAATTGG
17581 AGCAGTCTCT GGAGCGGGCT TAAGAATTTC GGGTCCACGC TCAAAACCTA TGGCAACAAG
17641 GCGTGGAACA GCAGCACAGG GCAGGCGCTG AGGGAAAAGC TGAAAGAGCA GAACTTCCAG
17701 CAGAAGGTGG TCGATGGCCT GGCCTCGGGC ATCAACGGGG TGGTGGACCT GGCCAACCAG
17761 GCCGTGCAGA AACAGATCAA CAGCCGCCTG GACGCGGTCC CGCCCGCGGG GTCCGTGGAG
17821 ATGCCCCAGG TGGAGGAGGA GCTGCCTCCC CTGGACAAGC GCGGCGACAA GCGACCGCGT
17881 CCCGACGCGG AGGAGACGCT GCTGACGCAC ACGGACGAGC CGCCCCGTA CGAGGAGGCG
17941 GTGAAACTGG GTCTGCCCAC CACGCGGCCC GTGGCGCCTC TGGCCACCGG GGTGCTGAAA
18001 CCCAGCAGCA GCAGCCAGCC CGCGACCCTG GACTTGCCTC CGCCTGCTTC CCGCCCCTCC
18061 ACAGTGGCTA AGCCCCTGCC GCCGGTGGCC GTCGCGTCGC GCGCCCCCCG AGGCCGCCCC
18121 CAGGCGAACT GGCAGAGCAC TCTGAACAGC ATCGTGGGTC TGGGAGTGCA GAGTGTGAAG
18181 CGCCGCCGCT GCTATTAAAA GACACTGTAG CGCTTAACTT GCTTGTCTGT GTGTATATGT
18241 ATGTCCGCCG ACCAGAAGGA GGAAGAGGCG CGTCGCCGAG TTGCAAGATG CCACCCCAT
18301 CGATGCTGCC CCAGTGGGCG TACATGCACA TCGCCGGACA GGACGCTTCG GAGTACCTGA
18361 GTCCGGGTCT GGTGCAGTTC GCCCGCGCCA CAGACACCTA CTTCAGTCTG GGAACAAGT
18421 TTAGGAACCC CACGGTGGCG CCCACGCACG ATGTGACCAC CGACCGCAGC CAGCGGCTGA
18481 CGCTGCGCTT CGTGCCCGTG GACCGCGAGG ACAACACCTA CTCGTACAAA GTGCGCTACA
18541 CGCTGGCCGT GGGCGACAAC CGCGTGCTGG ACATGGCCAG CACCTACTTT GACATCCGCG
18601 GCGTGCTGGA TCGGGGGCCC AGCTTCAAAC CCTACTCCGG CACCGCCTAC AACAGCCTGG
18661 CTCCCAAGGG AGCGCCCAAC ACTTGCCAGT GGACATATAA AGCTGGTGAT ACTGATACAG
18721 AAAAAACCTA TACATATGGA AATGCACCTG TGCAAGGCAT TAGCATTACA AAGGATGGTA
18781 TTCAACTTGG AACTGACAGC GATGGTCAGG CAATCTATGC AGACGAAACT TATCAACCAG
18841 AGCCTCAAGT GGGTGATGCT GAATGGCATG ACATCACTGG TACTGATGAA AAATATGGAG
18901 GCAGAGCTCT TAAGCCTGAC ACCAAAATGA AGCCTTGCTA TGGTTCTTTT GCCAAGCCTA
18961 CCAATAAAGA AGGAGGCCAG GCAAATGTGA AAACCGAAAC AGGCGGTACC AAAGAATATG
19021 ACATTGACAT GGCATTCTTC GATAATCGAA GTGCAGCTGC CGCCGGCCTA GCCCCAGAAA
19081 TTGTTTTGTA TACTGAGAAT GTGGATCTGG AAACTCCAGA TACCCATATT GTATACAAGG
19141 CAGGTACAGA TGACAGTAGC TCTTCTATCA ATTTGGGTCA GCAGTCCATG CCCAACAGAC
19201 CCAACTACAT TGGCTTCAGA GACAACTTTA TCGGTCTGAT GTACTACAAC AGCACTGGCA
19261 ATATGGGTGT ACTGGCTGGA CAGGCCTCCC AGCTGAATGC TGTGGTGGAC TTGCAGGACA
19321 GAAACACCGA ACTGTCCTAC CAGCTCTTGC TTGACTCTCT GGGTGACAGA ACCAGGTATT
19381 TCAGTATGTG GAATCAGGCG GTGGACAGTT ATGACCCCGA TGTGCGCATT ATTGAAAATC
19441 ACGGTGTGGA GGATGAACTT CCTAACTATT GCTTCCCCCT GGATGCTGTG GGTAGAACTG
19501 ATACTTACCA GGGAATTAAG GCCAATGGTG ATAATCAAAC CACCTGGACC AAAGATGATA
19561 CTGTTAATGA TGCTAATGAA TTGGGCAAGG GCAATCCTTT CGCCATGGAG ATCAACATCC
19621 AGGCCAACCT GTGGCGGAAC TTCCTCTACG CGAACGTGGC GCTGTACCTG CCCGACTCCT
19681 ACAAGTACAC GCCGGCCAAC ATCACGCTGC CCACCAACAC CAACACCTAC GATTACATGA
19741 ACGGCCGCGT GGTGGCGCCC TCGCTGGTGG ACGCCTACAT CAACATCGGG GCGCGCTGGT
19801 CGCTGGACCC CATGGACAAC GTCAACCCCT TCAACCACCA CCGCAACGCG GCCTGCGAT
19861 ACCGCTCCAT GCTCCTGGGC AACGGGCGCT ACGTGCCCTT CCACATCCAG GTGCCCCAAA
19921 AGTTTTTCGC CATCAAGAGC CTCCTGCTCC TGCCCGGGTC CTACACCTAC GAGTGGAACT
19981 TCCGCAAGGA CGTCAACATG ATCCTGCAGA GCTCCCTCGG CAACGACCTG CGCACGGACG
20041 GGGCCTCCAT CGCCTTCACC AGCATCAACC TCTACGCCAC CTTCTTCCCC ATGGCGCACA
20101 ACACCGCCTC CACGCTCGAG GCCATGCTGC GCAACGACAC CAACGACCAG TCCTTCAACG
20161 ACTACCTCTC GGCGGCCAAC ATGCTCTACC CCATCCCGGC CAACGCCACC AACGTGCCCA
20221 TCTCCATCCC CTCGCGCAAC TGGGCCGCCT TCCGCGGCTG GTCCTTCACG CGCCTCAAGA
20281 CCCGCGAGAC GCCCTCGCTC GGCTCCGGGT CGACCCCTA CTTCGTCTAC TCGGGCTCCA
20341 TCCCCTACCT CGACGGCACC TTCTACCTCA ACCACACCTT CAAGAAGGTC TCCATCACCT
20401 TCGACTCCTC CGTCAGCTGG CCCGGCAACG ACCGCCTCCT GACGCCCAAC GAGTTCGAAA
20461 TCAAGCGCAC CGTCGACGGA GAGGGGTACA ACGTGGCCCA GTGCAACATG ACCAAGGACT
20521 GGTTCCTGGT CCAGATGCTG GCCCACTACA ACATCGGCTA CCAGGGCTTC TACGTGCCCG
20581 AGGGCTACAA GGACCGCATG TACTCCTTCT TCCGCAACTT CCAGCCCATG AGCCGCCAGG
20641 TCGTGGACGA GGTCAACTAC AAGGACTACC AGGCCGTCAC CCTGGCCTAC CAGCACAACA
20701 ACTCGGGCTT CGTCGGCTAC CTCGCGCCCA CCATGCGCCA GGGCCAGCCC TACCCCGCCA
20761 ACTACCCCTA CCCGCTCATC GGCAAGAGCG CCGTCGCCAG CGTCACCCAG AAAAAGTTCC
20821 TCTGCGACCG GGTCATGTGG CGCATCCCCT TCTCCAGCAA CTTCATGTCC ATGGGCGCGC
```

FIG. 8F

```
20881 TCACCGACCT CGGCCAGAAC ATGCTCTACG CCAACTCCGC CCACGCGCTA GACATGAATT
20941 TCGAAGTCGA CCCCATGGAT GAGTCCACCC TTCTCTATGT TGTCTTCGAA GTCTTCGACG
21001 TCGTCCGAGT GCACCAGCCC CACCGCGGCG TCATCGAGGC CGTCTACCTG CGCACGCCCT
21061 TCTCGGCCGG CAACGCCACC ACCTAAGCCT CTTGCTTCTT GCAAGATGAC GGCCTGCGCG
21121 GGCTCCGGCG AGCAGGAGCT CAGGGCCATC CTCCGCGACC TGGGCTGCGG GCCCTGCTTC
21181 CTGGGCACCT TCGACAAGCG CTTCCCGGGA TTCATGGCCC CGCACAAGCT GGCCTGCGCC
21241 ATCGTCAACA CGGCCGGCCG CGAGACCGGG GGCGAGCACT GGCTGGCCTT CGCCTGGAAC
21301 CCGCGCTCCC ACACCTGCTA CCTCTTCGAC CCCTTCGGGT TCTCGGACGA GCGCCTCAAG
21361 CAGATCTACC AGTTCGAGTA CGAGGGCCTG CTGCGTCGCA GCGCCCTGGC CACCGAGGAC
21421 CGCTGCGTCA CCCTGGAAAA GTCCACCCAG ACCGTGCAGG GTCCGCGCTC GGCCGCCTGC
21481 GGGCTCTTCT GCTGCATGTT CCTGCACGCC TTCGTGCACT GGCCCGACCG CCCCATGGAC
21541 AAGAACCCCA CCATGAACTT GCTGACGGGG GTGCCCAACG GCATGCTCCA GTCGCCCCAG
21601 GTGGAACCCA CCCTGCGCCG CAACCAGGAG GCGCTCTACC GCTTCCTCAA CGCCCACTCC
21661 GCCTACTTTC GCTCCCACCG CGCGCGCATC GAGAAGGCCA CCGCCTTCGA CCGCATGAAT
21721 CAAGACATGT AATCCGGTGT GTGTATGTGA ATGCTTTATT CATCATAATA AACAGCACAT
21781 GTTTATGCCA CCTTCTCTGA GGCTCTGACT TTATTTAGAA ATCGAAGGGG TTCTGCCGGC
21841 TCTCGGCATG GCCCGCGGGC AGGGATACGT TGCGGAACTG GTACTTGGGC AGCCACTTGA
21901 ACTCGGGGAT CAGCAGCTTC GGCACGGGGA GGTCGGGGAA CGAGTCGCTC ACAGCTTGC
21961 GCGTGAGTTG CAGGGCGCCC AGCAGGTCGG GCGCGGAGAT CTTGAAATCG CAGTTGGGAC
22021 CCGCGTTCTG CGCGCGAGAG TTACGGTACA CGGGGTTGCA GCACTGGAAC ACCATCAGGG
22081 CCGGGTGCTT CACGCTCGCC AGCACCGTCG CGTCGGTGAT GCCCTCCACG TCCAGATCCT
22141 CGGCGTTGGC CATCCCGAAG GGGGTCATCT TGCAGGTCTG CCGCCCCATG CTGGGCACGC
22201 AGCCGGGCTT GTGGTTGCAA TCGCAGTGCA GGGGGATCAG CATCATCTGG GCCTGCTCGG
22261 AGCTCATGCC CGGGTACATG GCCTTCATGA AAGCCTCCAG CTGGCGGAAG GCCTGCTGCG
22321 CCTTGCCGCC CTCGGTGAAG AAGACCCCGC AGGACTTGCT AGAGAACTGG TTGGTGGCGC
22381 AGCCAGCGTC GTGCACGCAG CAGCGCGCGT CGTTGTTGGC CAGCTGCACC ACGCTGCGCC
22441 CCCAGCGGTT CTGGGTGATC TTGGCCCGGT CGGGGTTCTC CTTCAGCGCG CGCTGCCCGT
22501 TCTCGCTCGC CACATCCATC TCGATCGTGT GCTCCTTCTG GATCATCACG GTCCCGTGCA
22561 GGCACCGCAG CTTGCCCTCG GCCTCGGTGC ACCCGTGCAG CCACAGCGCG CAGCCGGTGC
22621 TCTCCCAGTT CTTGTGGGCG ATCTGGGAGT GCGAGTGCAC GAAGCCCTGC AGGAAGCGGC
22681 CCATCATCGT GGTCAGGGTC TTGTTGCTGG TGAAGGTCAG CGGAATGCCG CGGTGCTCCT
22741 CGTTCACATA CAGGTGGCAG ATACGGCGGT ACACCTCGCC CTGCTCGGGC ATCAGCTGGA
22801 AGGCGGACTT CAGGTCGCTC TCCACGCGGT ACCGGTCCAT CAGCAGCGTC ATCACTTCCA
22861 TGCCCTTCTC CCAGGCCGAA ACGATCGGCA GGCTCAGGGG GTTCTTCACC GTTGTCATCT
22921 TAGTCGCCGC CGCCGAAGTC AGGGGGTCGT TCTCGTCCAG GGTCTCAAAC ACTCGCTTGC
22981 CGTCCTTCTC GGTGATGCGC ACGGGGGGAA AGCTGAAGCC CACGGCCGCC AGCTCCTCCT
23041 CGGCCTGCCT TTCGTCCTCG CTGTCCTGGC TGATGTCTTG CAAAGGCACA TGCTTGGTCT
23101 TGCGGGGTTT CTTTTTGGGC GGCAGAGGCG GCGGCGGAGA CGTGCTGGGC GAGCGCGAGT
23161 TCTCGCTCAC CACGACTATT TCTTCTCCTT GGCCGTCGTC CGAGACCACG CGGCGGTAGG
23221 CATGCCTCTT CTGGGGCAGA GGCGGAGGCG ACGGGCTCTC GCGGTTCGGC GGGCGGCTGG
23281 CAGAGCCCCT TCCGCGTTCG GGGGTGCGCT CCTGGCGGCG CTGCTCTGAC TGACTTCCTC
23341 CGCGGCCGGC CATTGTGTTC TCCTAGGGAG CAAGCATGGA GACTCAGCCA TCGTCGCCAA
23401 CATCGCCATC TGCCCCCGCC GCCGCCGACG AGAACCAGCA GCAGCAGAAT GAAAGCTTAA
23461 CCGCCCCGCC GCCCAGCCCC ACCTCCGACG CCGCAGCCCC AGACATGCAA GAGATGGAGG
23521 AATCCATCGA GATTGACCTG GGCTACGTGA CGCCCGCGGA GCACGAGGAG GAGCTGGCAG
23581 CGCGCTTTTC AGCCCCGGAA GAGAACCACC AAGAGCAGCC AGAGCAGGAA GCAGAGAGCG
23641 AGCAGAACCA GGCTGGGCTC GAGCATGGCG ACTACCTGAG CGGGGCAGAG GACGTGCTCA
23701 TCAAGCATCT GGCCCGCCAA TGCATCATCG TCAAGGACGC GCTGCTCGAC CGCGCCGAGG
23761 TGCCCCTCAG CGTGGCGGAG CTCAGCCGCG CCTACGAGCG CAACCTCTTC TCGCCGCGCG
23821 TGCCCCCCAA GCGCCAGCCC AACGGCACCT GCGAGCCCAA CCCGCGCCTC AACTTCTACC
23881 CGGTCTTCGC GGTGCCCGAG GCCCTGGCCA CCTACCACCT CTTTTTCAAG AACCAAAGGA
23941 TCCCCGTCTC CTGCCGCGCC AACCGCACCC GCGCCGACGC CCTGCTCAAC CTGGGCCCCG
24001 GCGCCCGCCT ACCTGATATC GCCTCCTTGG AAGAGGTTCC CAAGATCTTC GAGGGTCTGG
24061 GCAGCGACGA GACTCGGGCC GCGAACGCTC TGCAAGGAAG CGGAGAGGAG CATGAGCACC
24121 ACAGCGCCCT GGTGGAGTTG GAAGGCGACA ACGCGCGCCT GGCGGTCCTC AAGCGCACGG
24181 TCGAGCTGAC CCACTTCGCC TACCCGGCGC TCAACCTGCC CCCCAAGGTC ATGAGCGCCG
24241 TCATGGACCA GGTGCTCATC AAGCGCGCCT CGCCCCTCTC GGAGGAGGAG ATGCAGGACC
24301 CCGAGAGCTC GGACGAGGGC AAGCCCGTGG TCAGCGACGA GCAGCTGGCG CGCTGGCTGG
```

FIG. 8G

```
25561 GAGAGCAGTC AGGCAGAGGA GGAGGAGATG GAAGACTGGG ACAGCACTCA GGCAGAGGAG
24361 GAGCGAGTAG CACCCCCCAG AGCCTGGAAG AGCGGCGCAA GCTCATGATG GCCGTGGTCC
24421 TGGTGACCGT GGAGCTGGAG TGTCTGCGCC GCTTCTTCGC CGACGCGGAG ACCCTGCGCA
24481 AGGTCGAGGA GAACCTGCAC TACCTCTTCA GACACGGGTT CGTGCGCCAG GCCTGCAAGA
24541 TCTCCAACGT GGAGCTGACC AACCTGGTCT CCTACATGGG CATCCTGCAC GAGAACCGCC
24601 TGGGGCAGAA CGTGCTGCAC ACCACCCTGC GCGGGGAGGC CCGCCGCGAC TACATCCGCG
24661 ACTGCGTCTA CCTGTACCTC TGCCACACCT GGCAGACGGG CATGGGCGTG TGGCAGCAGT
24721 GCCTGGAGGA GCAGAACCTG AAAGAGCTCT GCAAGCTCCT GCAGAAGAAC CTCAAGGCCC
24781 TGTGGACCGG GTTCGACGAG CGCACCACCG CCGCGGACCT GGCCGACCTC ATCTTCCCCG
24841 AGCGCCTGCG GCTGACGCTG CGCAACGGGC TGCCCGACTT TATGAGCCAA AGCATGTTGC
24901 AAAACTTTCG CTCTTTCATC CTCAACGCT CCGGGATCCT GCCCGCCACC TGCTCCGCGC
24961 TGCCCTCGGA CTTCGTGCCG CTGACCTTCC GCGAGTGCCC CCGCCGCTC TGGAGCCACT
25021 GCTACCTGCT GCGCCTGGCC AACTACCTGG CCTACCACTC GGACGTGATC GAGGACGTCA
25081 GCGGCGAGGG CCTGCTCGAG TGCCACTGCC GCTGCAACCT CTGCACGCCG CACCGCTCCC
25141 TGGCCTGCAA CCCCCAGCTG CTGAGCGAGA CCCAGATCAT CGGCACCTTC GAGTTGCAAG
25201 GCCCCGGCGA GGGCAAGGGG GGTCTGAAAC TCACCCCGGG GCTGTGGACC TCGGCCTACT
25261 TGCGCAAGTT CGTGCCCGAG GACTACCATC CCTTCGAGAT CAGGTTCTAC GAGGACCAAT
25321 CCCAGCCGCC CAAGGCCGAG CTGTCGGCCT GCGTCATCAC CCAGGGGGCC ATCCTGGCCC
25381 AATTGCAAGC CATCCAGAAA TCCCGCCAAG AATTTCTGCT GAAAAAGGGC CACGGGGTCT
25441 ACTTGGACCC CCAGACCGGA GAGGAGCTCA ACCCCAGCTT CCCCCAGGAT GCCCCGAGGA
25501 AGCAGCAAGA AGCTGAAAGT GGAGCTGCCG CCGCCGCCGG AGGATTTGGA GGAAGACTGG
25621 GACAGCCTGC AAGACAGTCT GGAGGAGGAA GACGAGGTGG AGGAGGCAGA GGAAGAAGCA
25681 GCCGCCGCCA GACCGTCGTC CTCGGCGGAG GAGGAGAAAG CAAGCAGCAC GGATACCATC
25741 TCCGCTCCGG GTCGGGGTCG CGGCGGCCGG GCCCACAGTA GATGGGACGA GACCGGGCGC
25801 TTCCCGAACC CCACCACCCA GACCGGTAAG AAGGAGCGGC AGGGATACAA GTCCTGGCGG
25861 GGGCACAAAA ACGCCATCGT CTCCTGCTTG CAAGCCTGCG GGGCAACAT CTCCTTCACC
25921 CGGCGCTACC TGCTCTTCCA CCGCGGGGTG AACTTCCCCC GCAACATCTT GCATTACTAC
25981 CGTCACCTCC ACAGCCCCTA CTACTGTTTC CAAGAAGAGG CAGAAACCCA GCAGCAGCAG
26041 CAGCAGCAGA AAACCAGCGG CAGCAGCTAG AAAATCCACA GCGGCGGCAG GTGGACTGAG
26101 GATCGCGGCG AACGAGCCGG CGCAGACCCG GGAGCTGAGG AACCGGATCT TTCCCACCCT
26161 CTATGCCATC TTCCAGCAGA GTCGGGGCA AGAGCAGGAA CTGAAAGTCA GAACCGTTC
26221 TCTGCGCTCG CTCACCCGCA GTTGTCTGTA TCACAAGAGC GAAGACCAAC TTCAGCGCAC
26281 TCTCGAGGAC GCCGAGGCTC TCTTCAACAA GTACTGCGCG CTCACTCTTA AAGAGTAGCC
26341 CGCGCCCGCC CACACACGGA AAAAGGCGGG AATTACGTCA CCACCTGCGC CCTTCGCCCG
26401 ACCATCATCA TGAGCAAAGA GATTCCCACG CCTTACATGT GGAGCTACCA GCCCCAGATG
26461 GGCCTGGCCG CCGGCGCCGC CCAGGACTAC TCCACCCGCA TGAACTGGCT CAGTGCCGGG
26521 CCCGCGATGA TCTCACGGGT GAATGACATC CGCGCCCACC GAAACCAGAT ACTCCTAGAA
26581 CAGTCAGCGA TCACCGCCAC GCCCCGCCAT CACCTTAATC GCGTAATTG CCCGCCGCC
26641 CTGGTGTACC AGGAAATTCC CCAGCCCACG ACCGTACTAC TTCCGCGAGA CGCCCAGGCC
26701 GAAGTCCAGC TGACTAACTC AGGTGTCCAG CTGGCCGGCG GCGCCGCCCT GTGTCGTCAC
26761 CGCCCCGCTC AGGGTATAAA GCGGCTGGTG ATCCGAGGCA GAGGCACACA GCTCAACGAC
26821 GAGGTGGTGA GCTCTTCGCT GGGTCTGCGA CCTGACGGAG TCTTCCAACT CGCCGGATCG
26881 GGGAGATCTT CCTTCACGCC TCGTCAGGCC GTCCTGACTT TGGAGAGTTC GTCCTCGCAG
26941 CCCCGCTCGG GTGGCATCGG CACTCTCCAG TTCGTGGAGG AGTTCACTCC CTCGGTCTAC
27001 TTCAACCCCT TCTCCGGCTC CCCCGGCCAC TACCCGGACG AGTTCATCCC GAACTTCGAC
27061 GCCATCAGCG AGTCGGTGGA CGGCTACGAT TGAATGTCCC ATGGTGGCGC GGCTGACCTA
27121 GCTCGGCTTC GACACCTGGA CCACTGCCGC CGCTTCCGCT GCTTCGCTCG GGATCTCGCC
27181 GAGTTTGCCT ACTTTGAGCT GCCCGAGGAG CACCCTCAGG GCCCGGCCCA CGGAGTGCGG
27241 ATCGTCGTCG AAGGGGGTCT CGACTCCAC CTGCTTCGGA TCTTCAGCCA GCGTCCGATC
27301 CTGGCCGAGC GCGAGCAAGG ACAGACCCTT CTGACCCTGT ACTGCATCTG CAACCACCCC
27361 GGCCTGCATG AAAGTCTTTG TTGTCTGCTG TGTACTGAGT ATAATAAAAG CTGAGATCAG
27421 CGACTACTCC GGACTTCCGT GTGTTCCTGC TATCAACCAG TCCCTGTTCT TCACCGGGAA
27481 CGAGACCGAG CTCCAGCTCC AGTGTAAGCC CCACAAGAAG TACCTCACCT GGCTGTTCCA
27541 GGGCTCTCCG ATCGCCGTTG TCAACCACTG CGACAACGAC GGAGTCCTGC TGAGCGGCCC
27601 TGCCAACCTT ACTTTTTCCA CCCGCAGAAG CAAGCTCCAG CTCTTCCAAC CCTTCCTCCC
27661 CGGGACCTAT CAGTGCGTCT CGGGACCCTG CCATCACACC TTCCACCTGA TCCCGAATAC
27721 CACAGCGTCG CTCCCCGCTA CTAACAACCA AACTACCCAC CAACGCCACC GTCGCGACCT
27781 TTCCTCTGGG TCTAATACCA CTACCGGAGG TGAGCTCCGA GGTCGACCAA CCTCTGGGAT
```

FIG. 8H

```
27841  TTACTACGGC CCCTGGGAGG TGGTAGGGTT AATAGCGCTA GGCCTAGTTG CGGGTGGGCT
27901  TTTGGCTCTC TGCTACCTAT ACCTCCCTTG CTGTTCGTAC TTAGTGGTGC TGTGTTGCTG
27961  GTTTAAGAAA TGGGGAAGAT CACCCTAGTG AGCTGCGGTG TGCTGGTGGC GGTGGTGCTT
28021  TCGATTGTGG GACTGGGCGG CGCGGCTGTA GTGAAGGAGA AGGCCGATCC CTGCTTGCAT
28081  TTCAATCCCG ACAAATGCCA GCTGAGTTTT CAGCCCGATG GCAATCGGTG CGCGGTGCTG
28141  ATCAAGTGCG GATGGGAATG CGAGAACGTG AGAATCGAGT ACAATAACAA GACTCGGAAC
28201  AATACTCTCG CGTCCGTGTG GCAGCCCGGG GACCCCGAGT GGTACACCGT CTCTGTCCCC
28261  GGTGCTGACG GCTCCCCGCG CACCGTGAAT AATACTTTCA TTTTTGCGCA CATGTGCGAC
28321  ACGGTCATGT GGATGAGCAA GCAGTACGAT ATGTGGCCCC CCACGAAGGA GAACATCGTG
28381  GTCTTCTCCA TCGCTTACAG CGTGTGCACG GCGCTAATCA CCGCTATCGT GTGCCTGAGC
28441  ATTCACATGC TCATCGCTAT TCGCCCCAGA AATAATGCCG AAAAGAAAA ACAGCCATAA
28501  CACGTTTTTT CACACACCTT TTTCAGACCA TGGCCTCTGT TAAATTTTTG CTTTTATTTG
28561  CCAGTCTCAT TGCCGTCATT CATGGAATGA GTAATGAGAA AATTACTATT TACACTGGCA
28621  CTAATCACAC ATTGAAAGGT CCAGAAAAAG CCACAGAAGT TTCATGGTAT TGTTATTTTA
28681  ATGAATCAGA TGTATCTACT GAACTCTGTG GAAACAATAA CAAAAAAAT GAGAGCATTA
28741  CTCTCATCAA GTTTCAATGT GGATCTGACT TAACCCTAAT TAACATCACT AGAGACTATG
28801  TAGGTATGTA TTATGGAACT ACAGCAGGCA TTTCGGACAT GGAATTTAT CAAGTTTCTG
28861  TGTCTGAACC CACCACGCCT AGAATGACCA CAACCACAAA AACTACACCT GTTACCACTA
28921  TACAGCTCAC TACCAATGGC TTTCTTGCCA TGCTTCAAGT GGCTGAAAAT AGCACCAGCA
28981  TTCAACCCAC CCCACCCAGT GAGGAAATTC CCAGATCCAT GATTGGCATT ATTGTTGCTG
29041  TAGTGGTGTG CATGTTGATC ATCGCCTTGT GCATGGTGTA CTATGCCTTC TGCTACAGAA
29101  AGCACAGACT GAACGACAAG CTGGAACACT TACTAAGTGT TGAATTTTAA TTTTTTAGAA
29161  CCATGAAGAT CCTAGGCCTT TTAGTTTTTT CTATCATTAC CTCTGCTCTA TGCAATTCTG
29221  ACAATGAGGA CGTTACTGTC GTTGTCGGAT CAAATTATAC ACTAAAAGGT CCAGCAAAAG
29281  GTATGCTTTC GTGGTATTGT TGGTTCGGAA CTGACGAGCA ACAGACAGAA CTTTGCAATG
29341  CTCAAAAAGG CAAAACCTCA AATTCTAAAA TCTCTAATTA TCAATGCAAT GGCACTGACT
29401  TAGTATTGCT CAATGTCACG AAAGCATATG CTGGCAGTTA CACCTGCCCT GGAGATGATG
29461  CCGACAATAT GATTTTTTAC AAAGTGGAAG TGGTTGATCC CACTACTCCA CCGCCCACCA
29521  CCACAACTAC TCATACCACA CACACAGAAC AAACACCAGA GGCAGCAGAA GCAGAGTTGG
29581  CCTTCCAGGT TCACGGAGAT TCCTTTGCTG TCAATACCCC TACACCCGAT CAGCGGTGTC
29641  CGGGGCTGCT CGTCAGCGGC ATTGTCGGTG TGCTTTCGGG ATTAGCAGTC ATAATCATCT
29701  GCATGTTCAT TTTTGCTTGC TGCTATAGAA GGCTTTACCG ACAAAAATCA GACCCACTGC
29761  TGAACCTCTA TGTTTAATTT TTTCCAGAGC CATGAAGGCA GTTAGCGCTC TAGTTTTTTG
29821  TTCTTTGATT GGCATTGTTT TTAGTGCTGG GTTTTGAAA AATCTTACCA TTTATGAAGG
29881  TGAGAATGCC ACTCTAGTGG GCATCAGTGG TCAAAATGTC AGCTGGCTAA AATACCATCT
29941  AGATGGGTGG AAAGACATTT GCGATTGGAA TGTCACTGTG TATACATGTA ATGGAGTTAA
30001  CCTCACCATT ACTAATGCCA CCAAGATCA GAATGGTAGG TTTAAGGGCC AGAGTTTCAC
30061  TAGAAATAAT GGGTATGAAT CCCATAACAT GTTTATCTAT GACGTCACTG TCATCAGAAA
30121  TGAGACTGCC ACCACCACAC AGATGCCCAC TACACACAGT TCTACCACTA CTACCATGCA
30181  AACCACACAG ACAACCACTA CATCAACTCA GCATATGACC ACCACTACAG CAGCAAAGCC
30241  AAGTAGTGCA GCGCCTCAGC CCCAGGCTTT GGCTTTGAAA GCTGCACAAC CTAGTACAAC
30301  TACTAGGACC AATGAGCAGA CTACTGAATT TTTGTCCACT GTCGAGAGCC ACACCACAGC
30361  TACCTCCAGT GCCTTCTCTA GCACCGCCAA TCTCTCCTCG CTTTCCTCTA CACCAATCAG
30421  TCCCGCTACT ACTCCCACCC CAGCTCTTCT CCCCACTCCC CTGAAGCAAA CTGAGGACAG
30481  CGGCATGCAA TGGCAGATCA CCCTGCTCAT TGTGATCGGG TTGGTCATCC TGGCCGTGTT
30541  GCTCTACTAC ATCTTCTGCC GCCGCATTCC CAACGCGCAC CGCAAACCGG CCTACAAGCC
30601  CATCGTTATC GGGCAGCCGG AGCCGCTTCA GGTGGAAGGG GGTCTAAGGA ATCTTCTCTT
30661  CTCTTTTACA GTATGGTGAT TGAACTATGA TTCCTAGACA ATTCTTGATC ACTATTCTTA
30721  TCTGCCTCCT CCAAGTCTGT GCCACCCTCG CTCTGGTGGC CAACGCCAGT CCAGACTGTA
30781  TTGGGCCCTT CGCCTCCTAC GTGCTCTTTG CCTTCATCAC CTGCATCTGC TGCTGTAGCA
30841  TAGTCTGCCT GCTTATCACC TTCTTCCAGT TCATTGACTG GATCTTTGTG CGCATCGCCT
30901  ACCTGCGCCA CCACCCCCAG TACCGCGACC AGCGAGTGGC GCGGCTGCTC AGGCTCCTCT
30961  GATAAGCATG CGGGCTCTGC TACTTCTCGC GCTTCTGCTG TTAGTGCTCC CCGCCCCGT
31021  CGACCCCCGG TCCCCCACTC AGTCCCCCGA AGAGGTCCGC AAATGCAAAT TCCAAGAACC
31081  CTGGAAATTC CTCAAATGCT ACCGCCAAAA ATCAGACATG CTTCCCAGCT GGATCATGAT
31141  CATTGGGATC GTGAACATTC TGGCCTGCAC CCTCATCTCC TTTGTGATTT ACCCCTGCTT
31201  TGACTTTGGT TGGAACTCGC CAGAGGCGCT CTATCTCCCG CCTGAACCTG ACACACCACC
31261  ACAGCAACCT CAGGCACACG CACTACCACC ACCACAGCCT AGGCCACAAT ACATGCCCAT
```

FIG. 8I

```
31321 ATTAGACTAT GAGGCCGAGC CACAGCGACC CATGCTCCCC GCTATTAGTT ACTTCAATCT
31381 AACCGGCGGA GATGACTGAC CCACTGGCCA ACAACAACGT CAACGACCTT CTCCTGGACA
31441 TGGACGGCCG CGCCTCGGAG CAGCGACTCG CCCAACTTCG CATTCGCCAG CAGCAGGAGA
31501 GAGCCGTCAA GGAGCTGCAG GACGGCATAG CCATCCACCA GTGCAAGAAA GGCATCTTCT
31561 GCCTGGTGAA ACAGGCCAAG ATCTCCTACG AGGTCACCCC GACCGACCAT CGCCTCTCCT
31621 ACGAGCTCCT GCAGCAGCGC CAGAAGTTCA CCTGCCTGGT CGGAGTCAAC CCCATCGTCA
31681 TCACCCAGCA GTCGGGCGAT ACCAAGGGGT GCATCCACTG CTCCTGCGAC TCCCCCGACT
31741 GCGTCCACAC TCTGATCAAG ACCCTCTGCG GCCTCCGCGA CCTCCTCCCC ATGAACTAAT
31801 CACCCCCTTA TCCAGTGAAA TAAATATCAT ATTGATGATG ATTTAAATAA AAAATAATCA
31861 TTTGATTTGA AATAAAGATA CAATCATATT GATGATTTGA GTTTTAAAAA ATAAAGAATC
31921 ACTTACTTGA AATCTGATAC CAGGTCTCTG TCCATGTTTT CTGCCAACAC CACCTCACTC
31981 CCCTCTTCCC AGCTCTGGTA CTGCAGACCC CGGCGGGCTG CAAACTTCCT CCACACGCTG
32041 AAGGGGATGT CAAATTCCTC CTGTCCCTCA ATCTTCATTT TATCTTCTAT CAGATGTCCA
32101 AAAAGCGCGT CCGGGTGGAT GATGACTTCG ACCCCGTCTA CCCCTACGAT GCAGACAACG
32161 CACCGACCGT GCCCTTCATC AACCCCCCCT TCGTCTCTTC AGATGGATTC CAAGAGAAGC
32221 CCCTGGGGGT GCTGTCCCTG CGACTGGCTG ACCCCGTCAC CACCAAGAAC GGGGAAATCA
32281 CCCTCAAGCT GGGAGAGGGG GTGGACCTCG ACTCCTCGGG AAAACTCATC TCCAACACGG
32341 CCACCAAGGC CGCCGCCCCT CTCAGTTTTT CCAACAACAC CATTTCCCTT AACATGGATA
32401 CCCCTCTTTA TACCAAAGAT GGAAAATTAT CCTTACAAGT TTCTCCACCG TTAAACATAT
32461 TAAAATCAAC CATTCTGAAC ACATTAGCTG TAGCTTATGG ATCAGGTTTA GGACTGAGTG
32521 GTGGCACTGC TCTTGCAGTA CAGTTGGCCT CTCCACTCAC TTTTGATGAA AAAGGAAATA
32581 TTAAAATTAA CCTAGCCAGT GGTCCATTAA CAGTTGATGC AAGTCGACTT AGTATCAACT
32641 GCAAAGAGG GGTCACTGTC ACTACCTCAG GAGATGCAAT TGAAAGCAAC ATAAGCTGGC
32701 CTAAAGGTAT AAGATTTGAA GGTAATGGCA TAGCTGCAAA CATTGGCAGA GGATTGGAAT
32761 TTGGAACCAC TAGTACAGAG ACTGATGTCA CAGATGCATA CCCAATTCAA GTTAAATTGG
32821 GTACTGGCCT TACCTTTGAC AGTACAGGCG CCATTGTTGC TTGGAACAAA GAGGATGATA
32881 AACTTACATT ATGGACCACA GCCGACCCCT CGCCAAATTG CAAAATATAC TCTGAAAAAG
32941 ATGCCAAACT CACACTTTGC TTGACAAAGT GTGGAAGTCA AATTCTGGGT ACTGTGACTG
33001 TATTGGCAGT GAATAATGGA AGTCTCAACC CAATCACAAA CACAGTAAGC ACTGCACTCG
33061 TCTCCCTCAA GTTTGATGCA AGTGGAGTTT TGCTAAGCAG CTCCACATTA GACAAAGAAT
33121 ATTGGAACTT CAGAAAGGGA GATGTTACAC CTGCTGAGCC CTATACTAAT GCTATAGGTT
33181 TTATGCCTAA CATAAAGGCC TATCCTAAAA ACACATCTGC AGCTTCAAAA AGCCATATTG
33241 TCAGTCAAGT TTATCTCAAT GGGGATGAGG CCAAACCACT GATGCTGATT ATTACTTTTA
33301 ATGAAACTGA GGATGCAACT TGCACCTACA GTATCACTTT TCAATGAAA TGGGATAGTA
33361 CTAAGTACAC AGGTGAAACA CTTGCTACCA GCTCCTTCAC CTTCTCCTAC ATCGCCCAAG
33421 AATGAACACT GTATCCCACC CTGCATGCCA ACCCTTCCCA CCCCACTCTG TCTATGGAAA
33481 AAACTCTGAA GCACAAAATA AAATAAAGTT CAAGTGTTTT ATTGATTCAA CAGTTTTACA
33541 GGATTCGAGC AGTTATTTTT CCTCCACCCT CCCAGGACAT GGAATACACC ACCCTCTCCC
33601 CCCGCACAGC CTTGAACATC TGAATGCCAT TGGTGATGGA CATGCTTTTG GTCTCCACGT
33661 TCCACACAGT TTCAGAGCGA GCCAGTCTCG GGTCGGTCAG GGAGATGAAA CCCTCCGGGC
33721 ACTCCCGCAT CTGCACCTCA CAGCTCAACA GCTGAGGATT GTCCTCGGTG GTCGGGATCA
33781 CGGTTATCTG GAAGAAGCAG AAGAGCGGCG GTGGGAATCA TAGTCCGCGA ACGGGATCGG
33841 CCGGTGGTGT CGCATCAGGC CCCGCAGCAG TCGCTGCCGC CGCCGCTCCG TCAAGCTGCT
33901 GCTCAGGGGG TCCGGGTCCA GGGACTCCCT CAGCATGATG CCCACGGCCC TCAGCATCAG
33961 TCGTCTGGTG CGGCGGGCGC AGCAGCGCAT GCGGATCTCG CTCAGGTCGC TGCAGTACGT
34021 GCAACACAGG ACCACCAGGT TGTTCAACAG TCCATAGTTC AACACGCTCC AGCCGAAACT
34081 CATCGCGGGA AGGATGCTAC CCACGTGGCC GTCGTACCAG ATCCTCAGGT AAATCAAGTG
34141 GCGCTCCCTC CAGAACACGC TGCCCACGTA CATGATCTCC TTGGGCATGT GGCGGTTCAC
34201 CACCTCCCGG TACCACATCA CCCTCTGGTT GAACATGCAG CCCCGGATGA TCCTGCGGAA
34261 CCACAGGGCC AGCACCGCCC CGCCGCCAT GCAGCGAAGA GACCCCGGGT CCCGGCAATG
34321 GCAATGGAGG ACCCACCGCT CGTACCCGTG GATCATCTGG GAGCTGAACA AGTCTATGTT
34381 GGCACAGCAC AGGCATATGC TCATGCATCT CTTCAGCACT CTCAGCTCCT CGGGGGTCAA
34441 AACCATATCC CAGGGCACGG GGAACTCTTG CAGGACAGCG AACCCGCAG AACAGGGCAA
34501 TCCTCGCACA TAACTTACAT TGTGCATGGA CAGGGTATCG CAATCAGGCA GCACCGGGTG
34561 ATCCTCCACC AGAGAAGCGC GGGTCTCGGT CTCCTCACAG CGTGGTAAGG GGGCCGGCCG
34621 ATACGGGTGA TGGCGGGACG CGGCTGATCG TGTTCGCGAC CGTGTCATGA TGCAGTTGCT
34681 TTCGGACATT TTCGTACTTG CTGTAGCAGA ACCTGGTCCG GGCGCTGCAC ACCGATCGCC
34741 GGCGGCGGTC CCGGCGCTTG GAACGCTCGG TGTTGAAATT GTAAACAGC CACTCTCTCA
```

FIG. 8J

```
34801 GACCGTGCAG CAGATCTAGG GCCTCAGGAG TGATGAAGAT CCCATCATGC CTGATAGCTC
34861 TGATCACATC GACCACCGTG GAATGGGCCA GACCCAGCCA GATGATGCAA TTTTGTTGGG
34921 TTTCGGTGAC GGCGGGGGAG GGAAGAACAG GAAGAACCAT GATTAACTTT TAATCCAAAC
34981 GGTCTCGGAG CACTTCAAAA TGAAGGTCGC GGAGATGGCA CCTCTCGCCC CCGCTGTGTT
35041 GGTGGAAAAT AACAGCCAGG TCAAAGGTGA TACGGTTCTC GAGATGTTCC ACGGTGGCTT
35101 CCAGCAAAGC CTCCACGCGC ACATCCAGAA ACAAGACAAT AGCGAAAGCG GGAGGGTTCT
35161 CTAATTCCTC AATCATCATG TTACACTCCT GCACCATCCC CAGATAATTT TCATTTTTCC
35221 AGCCTTGAAT GATTCGAACT AGTTCCTGAG GTAAATCCAA GCCAGCCATG ATAAAGAGCT
35281 CGCGCAGAGC GCCCTCCACC GGCATTCTTA AGCACACCCT CATAATTCCA AGATATTCTG
35341 CTCCTGGTTC ACCTGCAGCA GATTGACAAG CGGAATATCA AAATCTCTGC CGCGATCCCT
35401 AAGCTCCTCC CTCAGCAATA ACTGTAAGTA CTCTTTCATA TCCTCTCCGA AATTTTTAGC
35461 CATAGGACCA CCAGGAATAA GATTAGGGCA AGCCACAGTA CAGATAAACC GAAGTCCTCC
35521 CCAGTGAGCA TTGCCAAATG CAAGACTGCT ATAAGCATGC TGGCTAGACC CGGTGATATC
35581 TTCCAGATAA CTGGACAGAA AATCACCCAG GCAATTTTTA AGAAAATCAA CAAAAGAAAA
35641 ATCCTCCAGG TGCACGTTTA GAGCCTCGGG AACAACGATG AAGTAAATGC AAGCGGTGCG
35701 TTCCAGCATG GTTAGTTAGC TGATCTGTAA AAAACAAAAA ATAAAACATT AAACCATGCT
35761 AGCCTGGCGA ACAGGTGGGT AAATCGTTCT CTCCAGCACC AGGCAGGCCA CGGGGTCTCC
35821 GGCGCGACCC TCGTAAAAAT TGTCGCTATG ATTGAAAACC ATCACAGAGA GACGTTCCCG
35881 GTGGCCGGCG TGAATGATTC GACAAGATGA ATACACCCCC GGAACATTGG CGTCCGCGAG
35941 TGAAAAAAAG CGCCCGAGGA AGCAATAAGG CACTACAATG CTCAGTCTCA AGTCCAGCAA
36001 AGCGATGCCA TGCGGATGAA GCACAAAATC CTCAGGTGCG TACAAAATGT AATTACTCCC
36061 CTCCTGCACA GGCAGCGAAG CCCCCGATCC CTCCAGATAC ACATACAAAG CCTCAGCGTC
36121 CATAGCTTAC CGAGCAGCAG CACACAACAG GCGCAAGAGT CAGAGAAAGG CTGAGCTCTA
36181 ACCTGTCCAC CCGCTCTCTG CTCAATATAT AGCCCAGATC TACACTGACG TAAAGGCCAA
36241 AGTCTAAAAA TACCCGCCAA ATAATCACAC ACGCCCAGCA CACGCCCAGA AACCGGTGAC
36301 ACACTCAAAA AAATACGCGC ACTTCCTCAA ACGCCCAAAC TGCCGTCATT TCCGGGTTCC
36361 CACGCTACGT CATCGGAATT CGACTTTCAA ATTCCGTCGA CCGTTAAAAA CGTCACCCGC
36421 CCCGCCCCTA ACGGTCGCCC GTCTCTCGGC CAATCACCTT CCTCCCTCCC CAAATTCAAA
36481 CAGCTCATTT GCATATTAAC GCGCACCAAA AGTTTGAGGT ATATTATTGA TGATG
(SEQ ID NO: 4)
```

FIG. 8K

```
   1 catcatcaat aatatacctc aaacttttgg tgcgcgttaa tatgcaaatg aggtatttga
  61 atttggggat gcggggcggt gattggctgc gggagcggcg accgttaggg gcggggcggg
 121 tgacgttttg atgacgtggc cgtgaggcga agccggtttg caagttctcg tgggaaaagt
 181 gacgtcaaac gaggtgtggt ttgaacacgg aaatactcaa ttttcccgcg ctctctgaca
 241 ggaaatgagg tgtttctggg cggatgcaag tgaaaacggg ccatttttcgc gcgaaaactg
 301 aatgaggaag tgaaaatctg agtaattccg cgtttatggc agggaggagt atttgccgag
 361 ggccgagtag actttgaccg attacgtggg ggtttcgatt accgtatttt tcacctaaat
 421 ttccgcgtac ggtgtcaaag tccggtgttt ttacgtaggt gtcagctgat cgccagggta
 481 tttaaacctg cgctctctag tcaagaggcc actcttgagt gccagcgagt agagttttct
 541 cctccgcgcc gcgagtcaga tctacacttt gaaagatgag gcacctgaga gacctgcccg
 601 gtaatgtttt cctggctact gggaacgaga ttctggaact ggtggtggac gccatgatgg
 661 gtgacgaccc tccggagccc cctacCccat ttgaagcgcc ttcgctgtac gatttgtatg
 721 atctggaggt ggatgtgccc gagaacgacc ccaacgagga ggcggtgaat gatttgttta
 781 gcgatgccgc gctgctggct gccgagcagg ctaatacgga ctctggctca gacagcgatt
 841 cctctctcca taccccgaga cccggcagag gtgagaaaaa gatccccgag cttaaagggg
 901 aagagctcga cctgcgctgc tatgaggaat gcttgcctcc gagcgatgat gaggaggacg
 961 aggaggcgat tcgagctgca gcgaaccagg gagtgaaaac agcgagcgag ggctttagcc
1021 tggactgtcc tactctgccc ggacacggct gtaagtcttg tgaatttcat cgcatgaata
1081 ctggagataa gaatgtgatg tgtgccctgt gctatatgag agcttacaac cattgtgttt
1141 acagtaagtg tgattaactt tagctgggga ggcagagggt gactgggtgc tgactggttt
1201 atttatgtat atgttttta tgtgtaggtc ccgtctctga cgtagatgag acccccacta
1261 cagagtgcat ttcatcaccc ccagaaattg gcgaggaacc gcccgaagat attattcata
1321 gaccagttgc agtgagagtc accgggcgta gagcagctgt ggagagtttg gatgacttgc
1381 tacagggtgg ggatgaacct ttggacttgt gtacccggaa acgcccaggg cactaagtgc
1441 cacacatgtg tgtttactta aggtgatgtc agtatttata gggtgtggag tgcaataaaa
1501 tccgtgttga ctttaagtgc gtggtttatg actcaggggt ggggactgtg ggtatataag
1561 caggtgcaga cctgtgtggt cagttcagag caggactcat ggagatctgg acagtcttgg
1621 aagactttca ccagactaga cagctgctag agaactcatc ggagggagtc tcttacctgt
1681 ggagattctg cttcggtggg cctctagcta agctagtcta tagggccaag caggattata
1741 aggatcaatt tgaggatatt ttgagagagt gtcctggtat ttttgactct ctcaacttgg
1801 gccatcagtc tcactttaac cagagtattc tgagagccct tgacttttct actcctggca
1861 gaactaccgc cgcggtagcc ttttttgcct ttatccttga caaatggagt caagaaaccc
1921 atttcagcag ggattaccgt ctggactgct tagcagtagc tttgtggaga acatggaggt
1981 gccagcgcct gaatgcaatc tccggctact gccagtaca gccggtagac acgctgagga
2041 tcctgagtct ccagtcaccc caggaacacc aacgccgcca gcagccgcag caggagcagc
2101 agcaagagga ggaccgagaa gagaacctga gagccggtct ggaccctccg gtggcggagg
2161 aggaggagta gctgacttgt ttcccgagct gcgccgggtg ctgactaggt cttccagtgg
2221 acgggagagg gggattaagc gggagaggca tgaggagact agccacagaa ctgaactgac
2281 tgtcagtctg atgagtcgca ggcgcccaga atcggtgtgg tggcatgagg tgcagtcgca
2341 ggggatagat gaggtctcag tgatgcatga gaaatattcc ctagaacaag tcaagacttg
2401 ttggttggag cccgaggatg attgggaggt agccatcagg aattatgcca agctggctct
2461 gaggccagac aagaagtaca agattaccaa actgattaat atcagaaatt cctgctacat
2521 ttcagggaat ggggccgagg tgagatcag tacccaggag agggtggcct tcagatgctg
2581 catgatgaat atgtacccgg gggtggtggg catggaggga gtcacctta tgaacgcgag
2641 gttcaggggt gatgggtata atgggtggt ctttatggcc aacaccaagc tgacagtgca
2701 cggatgctcc ttctttggct tcaataacat gtgcattgag gcctggggca gtgtttcagt
2761 gagggggatgc agttttttcag ccaactggat ggggggtcgtg gcagaacca agagcatggt
2821 gtcagtgaag aaatgcctgt tcgagaggtg ccacctgggg gtgatgagcg agggcgaagc
2881 caaagtcaaa cactgcgcct ctaccgagac gggctgcttt gtactgatca agggcaatgc
2941 caaagtcaag cataatatga tctgtggggc ctcggatgag cgcggctacc agatgctgac
3001 ctgcgccggt gggaacagcc atatgctagc caccgtgcat gtgcctcgc acccccgcaa
3061 gacatggccc gagttcgagc acaacgtcat gacccgctgc aatgtgcacc tggggtcccg
3121 ccgaggcatg ttcatgcct accagtgcaa catgcaattt gtgaaggtgc tgctggagcc
3181 cgatgccatg tccagagtga gcctgacggg ggtgtttgac atgaatgtgg agctgtggaa
3241 aattctgaga tatgatgaat ccaagaccag gtgccgggcc tgcaatgcg aggcaagca
3301 cgccaggctt cagcccgtgt gtgtggaggt gacggaggac ctgcgacccg atcatttggt
3361 gttgtcctgc aacgggacgg agttcggctc cagcggggaa gaatctgact agagtgagta
3421 gtgtttggga ctgggtggga gcctgcatga tgggcagaat gactaaaatc tgtgtttttc
```

FIG. 9A

```
3481 tgcgcagcag catgagcgga agcgcctcct tgagggagg  ggtattcagc ccttatctga
3541 cggggcgtct cccctcctgg gcgggagtgc gtcagaatgt gatgggatcc acggtggacg
3601 gccggcccgt gcagcccgcg aactcttcaa ccctgaccta cgcgaccctg agctcctcgt
3661 ccgtggacgc agctgccgcc gcagctgctg cttccgccgc cagcgccgtg cgcggaatgg
3721 ccctgggcgc cggctactac agctctctgg tggccaactc gagttccacc aataatcccg
3781 ccagcctgaa cgaggagaag ctgctgctgc tgatggccca gctcgaggcc ctgacccagc
3841 gcctgggcga gctgacccag caggtggctc agctgcaggc ggagacgcgg ccgcggttg
3901 ccacggtgaa aaccaaataa aaaatgaatc aataaataaa cggagacggt tgttgatttt
3961 aacacagagt cttgaatctt tatttgattt ttcgcgcgcg gtaggccctg gaccaccggt
4021 ctcgatcatt gagcacccgg tggatctttt ccaggacccg gtagaggtgg gcttggatgt
4081 tgaggtacat gggcatgagc ccgtcccggg ggtggaggta gctccattgc agggcctcgt
4141 gctcggggt  ggtgttgtaa atcacccagt catagcaggg gcgcagggcg tggtgctgca
4201 cgatgtcctt gaggaggaga ctgatggcca cgggcagccc cttggtgtag gtgttgacga
4261 acctgttgag ctgggaggga tgcatgcggg gggagatgag atgcatcttg gcctggatct
4321 tgagattggc gatgttcccg cccagatccc gcggggggtt catgttgtgc aggaccacca
4381 gcacggtgta tccggtgcac ttggggaatt tgtcatgcaa cttggaaggg aaggcgtgaa
4441 agaatttgga gacgcccttg tgaccgccca ggttttccat gcactcatcc atgatgatgg
4501 cgatgggccc gtgggcggcg gcttgggcaa agacgtttcg ggggtcggac acatcgtagt
4561 tgtggtcctg ggtgagctcg tcataggcca ttttaatgaa tttggggcgg agggtgcccg
4621 actgggggac gaaggtgccc tcgatcccgg gggcgtagtt gccctcgcag atctgcatct
4681 cccaggcctt gagctcggag gggggatca  tgtccacctg cggggcgatg aaaaaaacgg
4741 tttccggggc ggggagatg  agctgggccg aaagcaggtt ccggagcagc tgggacttgc
4801 cgcagccggt ggggcgtag  atgacccga  tgaccggctg caggtggtag ttgagggaga
4861 gacagctgcc gtcctcgcgg aggagggggg ccacctcgtt catcatctcg cgcacatgca
4921 tgttctcgcg cacgagttcc gccaggaggc gctcgccccc aagcgagagg agctcttgca
4981 gcgaggcgaa gttttcagc  ggcttgagcc cgtcggccat gggcattttg gagagggtct
5041 gttgcaagag ttccagacgg tcccagagct cggtgatgtg ctctagggca tctcgatcca
5101 gcagacctcc tcgtttcgcg ggttgggcg  actgcgggag tagggcacca ggcgatgggc
5161 gtccagcgag gccagggtcc ggtccttcca ggggcgcagg gtccgcgtca gcgtggtctc
5221 cgtcacggtg aaggggtgcg cgccgggctg ggcgcttgcg agggtgcgct tcaggctcat
5281 ccggctggtc gagaaccgct cccggtcggc gccctgcgcg tcggccaggt agcaattgag
5341 catgagttcg tagttgagcg cctcggccgc gtggcccttg gcgcggagct tacctttgga
5401 agtgtgtccg cagacgggac agaggaggga cttgagggcg tagagcttgg gggcgaggaa
5461 gacggactcg ggggcgtagg cgtccgcgcc cagctggcg  cagacggtct cgcactccac
5521 gagccaggtg aggtctggcc ggtcgggtc  aaaaacgagg tttcctccgt gcttttgat
5581 gcgtttctta cctctggtct ccatgagctc gtgtccccgc tgggtgacaa agaggctgtc
5641 cgtgtccccg tagaccgact ttatgggccg gtcctcgagc ggggtgccgc ggtcctcgtc
5701 gtagaggaac cccgcccact ccgagacgaa ggcccgggtc caggccagca cgaaggaggc
5761 cacgtgggag gggtagcggt cgttgtccac cagcgggtcc accttctcca gggtatgcaa
5821 gcacatgtcc ccctcgtcca catccaggaa ggtgattggc ttgtaagtgt aggccacgtg
5881 accggggtc  ccggccgggg gggtataaaa gggggcgggc ccctgctcgt cctcactgtc
5941 ttccggatcg ctgtccagga gcgccagctg ttggggtagg tattccctct cgaaggcggg
6001 catgacctcg gcactcaggt tgtcagtttc tagaaacgag gaggatttga tattgacggt
6061 gccgttggag acgcctttca tgagcccctc gtccatctgg tcagaaaaga cgatctttt
6121 gttgtcgagc ttggtggcga aggagccgta gagggcgttg gagagcagct ggcgatgga
6181 gcgcatggtc tggttctttt ccttgtcggc gcgtccttg  gcggcgatgt tgagctgcac
6241 gtactcgcgc gccacgcact ccattcgggg aagacggtg  gtgagcttgt cgggcacgat
6301 tctgacccgc cagccgcggt tgtgcagggt gatgaggtcc acgctggtgg ccacctcgcc
6361 gcgcaggggc tcgttggtcc agcagaggcg cccgcccttg cgcagcaga  agggggcag
6421 cggtccagc  atgagctcgt cggggggtc  ggcgtccacg gtgaagatgc cgggcaggag
6481 ctcggggtcg aagtagctga tgcaggtgcc cagatcgtcc agcgccgctt ccagtcgcg
6541 cacggccagc gcgcgctcgt aggggctgag gggcgtgccc cagggcatgg ggtgcgtgag
6601 cgcggaggcg tacatgccgc agatgtcgta gacgtagagg ggctcctcga ggacgccgat
6661 gtaggtgggg tagcagcgcc cccgcggat  gctggcgcgc acgtagtcgt acagctcgtg
6721 cgagggcgcg aggagcccgg tgccgaggtt ggagcgctgc ggcttttcgg cgcggtagac
6781 gatctggcgg aagatggcgt gggagttgga ggagatggtg ggcctctgga agatgttgaa
6841 gtgggcgtgg ggcagtccga ccgagtccct gatgaagtgg gcgtaggagt cctgcagctt
6901 ggcgacgagc tcggcggtga cgaggacgtc cagggcgcag tagtcgaggg tctcttggat
```

FIG. 9B

```
6961 gatgtcgtac ttgagctggc ccttctgctt ccacagctcg cggttgagaa ggaactcttc
7021 gcggtccttc cagtactctt cgaggggaa cccgtcctga tcggcacggt aagagcccac
7081 catgtagaac tggttgacgg ccttgtaggc gcagcagccc ttctccacgg ggagggcgta
7141 agcttgcgcg gccttgcgca gggaggtgtg ggtgagggcg aaggtgtcgc gcaccatgac
7201 cttgaggaac tggtgcttga agtcgaggtc gtcgcagccg ccctgctccc agagctggaa
7261 gtccgtgcgc ttcttgtagg cggggttggg caaagcgaaa gtaacatcgt tgaagaggat
7321 cttgcccgcg cggggcatga agttgcgagt gatgcggaaa ggctggggca cctcggcccg
7381 gttgttgatg acctgggcgg cgaggacgat ctcgtcgaag ccgttgatgt tgtgcccgac
7441 gatgtagagt tccacgaatc gcgggcggcc cttgacgtgg ggcagcttct tgagctcgtc
7501 gtaggtgagc tcggcggggt cgctgaggcc gtgctgctcg agggcccagt cggcgaggtg
7561 ggggttggcg ccgaggaagg aagtccagag atccacggcc agggcggtct gcaagcggtc
7621 ccggtactga cggaactgct ggcccacggc catttttcg ggggtgacgc agtagaaggt
7681 gcgggggtcg ccgtgccagc ggtcccactt gagctggagg gcgaggtcgt gggcgagctc
7741 gacgagcggc gggtccccgg agagtttcat gaccagcatg aaggggacga gctgcttgcc
7801 gaaggacccc atccaggtgt aggtttccac gtcgtaggtg aggaagagcc tttcggtgcg
7861 aggatgcgag ccgatgggga agaactggat ctcctgccac cagttggagg aatggctgtt
7921 gatgtgatgg aagtagaaat gccgacggcg cgccgagcac tcgtgcttgt gtttatacaa
7981 gcgtccgcag tgctcgcaac gctgcacggg atgcacgtgc tgcacgagct gtacctgggt
8041 tcctttgacg aggaatttca gtgggcagtg gagcgctggc ggctgcatct ggtgctgtac
8101 tacgtcctgg ccatcggcgt ggccatcgtc tgcctcgatg gtggtcatgc tgacgaggcc
8161 gcgcgggagg caggtccaga cctcggctcg gacgggtcgg agagcgagga cgagggcgcg
8221 caggccggag ctgtccaggg tcctgagacg ctgcggagtc aggtcagtgg gcagcggcgg
8281 cgcgcggttg acttgcagga gcttttccag ggcgcgcggg aggtccagat ggtacttgat
8341 ctccacggcg ccgttggtgg cgacgtccac ggcttgcagg gtcccgtgcc cctggggcgc
8401 caccaccgtg ccccgtttct tcttgggtgc tggcggcggc ggctccatgc ttagaagcgg
8461 cggcgaggac gcgcgccggg cggcaggggc ggctcggggc ccggaggcag gggcggcagg
8521 ggcacgtcgg cgccgcgcgc gggcaggttc tggtactgcg cccggagaag actggcgtga
8581 gcgacgacgc gacggttgac gtcctggatc tgacgcctct gggtgaaggc cacgggaccc
8641 gtgagtttga acctgaaaga gagttcgaca gaatcaatct cggtatcgtt gacggcggcc
8701 tgccgcagga tctcttgcac gtcgcccgag ttgtcctggt aggcgatctc ggtcatgaac
8761 tgctcgatct cctcctcctg aaggtctccg cgaccggcgc gctcgacggt ggccgcgagg
8821 tcgttggaga tgcggcccat gagctgcgag aaggcgttca tgccggcctc gttccagacg
8881 cggctgtaga ccacggctcc gtcggggtcg cgcgcgcgca tgaccacctg ggcgaggttg
8941 agctcgacgt ggcgcgtgaa gaccgcgtag ttgcagaggc gctggtagag gtagttgagc
9001 gtggtggcga tgtgctcggt gacgaagaag tacatgatcc agcggcggag cggcatctcg
9061 ctgacgtcgc ccagggcttc caagcgctcc atggcctcgt agaagtccac ggcgaagttg
9121 aaaaactggg agttgcgcgc cgagacggtc aactcctcct ccagaagacg gatgagctcg
9181 gcgatggtgg cgcgcacctc gcgctcgaag gccccggggg gctcctcttc ttccatctcc
9241 tcctcctctt ccatctcctc cactaacatc tcttctactt cctcctcagg aggcggcggc
9301 gggggagggg ccctgcgtcg ccggcggcgc acgggcagac ggtcgatgaa gcgctcgatg
9361 gtctccccgc gccggcgacg catggtctcg gtgacggcgc gcccgtcctc gcggggccgc
9421 agcgtgaaga cgccgccgcg catctccagg tggccgccgg ggggtctcc gttgggcagg
9481 gagagggcgc tgacgatgca tcttatcaat tggcccgtag ggactccgcg caaggacctg
9541 agcgtctcga gatccacggg atccgaaaac cgctgaacga aggcttcgag ccagtcgcag
9601 tcgcaaggta ggctgagccc ggtttcttgt tcttcgggta tttggtcggg aggcgggcgg
9661 gcgatgctgc tggtgatgaa gttgaagtag gcggtcctga cggcggat ggtggcgagg
9721 agcaccaggt ccttgggccc ggcttgctgg atgcgcagac ggtcggccat gccccaggcg
9781 tggtcctgac acctggcgag gtccttgtag tagtcctgca tgagccgctc cacgggcacc
9841 tcctcctcgc ccgcgcggcc gtgcatgcgc gtgagcccga acccgcctg cggctggacg
9901 agcgccaggt cggcgacgac gcgctggcg aggatgcct gctggatctg ggtgagggtg
9961 gtctggaagt cgtcgaagtc gacgaagcgg tggtaggctc cggtgttgat ggtgtaggag
10021 cagttggcca tgacggacca gttgacggtc tggtggccgg ggcgcacgag ctcgtggtac
10081 ttgaggcgcg agtaggcgcg cgtgtcgaag atgtagtcgt tgcaggtgcg cacgaggtac
10141 tggtatccga cgaggaagtg cggcggcggc tggcggtaga gcggccatcg ctcggtggcg
10201 ggggcgccgg gcgcgaggtc ctcgagcatg aggcggtggt agccgtagat gtacctggac
10261 atccaggtga tgccggcggc ggtggtggag gcgcgcggga actcgcggac gcggttccag
10321 atgttgcgca gcggcaggaa gtagttcatg gtggccgcgg tctggcccgt gaggcgcgcg
10381 cagtcgtgga tgctctagac atacgggcaa aaacgaaagc ggtcagcggc tcgactccgt
```

FIG. 9C

```
10441 ggcctggagg ctaagcgaac gggttgggct gcgcgtgtac cccggttcga gtccctgctc
10501 gaatcaggct ggagccgcag ctaacgtggt actggcactc ccgtctcgac ccaagcctgc
10561 taacgaaacc tccaggatac ggaggcgggt cgttttggcc attttcgtca ggccggaaat
10621 gaaactagta agcgcggaaa gcggccgtcc gcgatggctc gctgccgtag tctggagaaa
10681 gaatcgccag ggttgcgttg cggtgtgccc cggttcgagc ctcagcgctc ggcgccggcc
10741 ggattccgcg gctaacgtgg gcgtggctgc ccgtcgtttt ccaagacccc ttagccagcc
10801 gacttctcca gttacggagc gagcccctct ttttcttgtg ttttgccag atgcatcccg
10861 tactgcggca gatgcgcccc caccctccac cacaaccgcc cctaccgcag cagcagcaac
10921 agccggcgct tctgcccccg ccccagcagc agcagccagc cactaccgcg gcggccgccg
10981 tgagcggagc cggcgttcag tatgacctgg ccttggaaga gggcgagggg ctggcgcggc
11041 tggggcgtc gtcgccggag cggcacccgc gcgtgcagat gaaaagggac gctcgcgagg
11101 cctacgtgcc caagcagaac ctgttcagag acaggagcgg cgaggagccc gaggagatgc
11161 gcgcctcccg cttccacgcg gggcgggagc tgcggcgcgg cctggaccga agcgggtgc
11221 tgagggacga ggatttcgag gcggacgagc tgacggggat cagccccgcg cgcgcgcacg
11281 tggccgcggc caacctggtc acggcgtacg agcagaccgt gaaggaggag agcaacttcc
11341 aaaaatcctt caacaaccac gtgcgcacgc tgatcgcgcg cgaggaggtg accctgggcc
11401 tgatgcacct gtgggacctg ctggaggcca tcgtgcagaa ccccacgagc aagccgctga
11461 cggcgcagct gtttctggtg gtgcagcaca gtcgggacaa cgagacgttc agggaggcgc
11521 tgctgaatat caccgagccc gagggccgct ggctcctgga cctggtgaac attctgcaga
11581 gcatcgtggt gcaggagcgc gggctgccgc tgtccgagaa gctggcggcc atcaacttct
11641 cggtgctgag cctgggcaag tactacgcta ggaagatcta caagacccg tacgtgccca
11701 tagacaagga ggtgaagatc gacgggtttt acatgcgcat gaccctgaaa gtgctgaccc
11761 tgagcgacga tctgggggtg taccgcaacg acaggatgca ccgcgcggtg agcgccagcc
11821 gccggcgcga gctgagcgac caggagctga tgcacagcct gcagcgggcc ctgaccgggg
11881 ccgggaccga gggggagagc tactttgaca tgggcgcgga cctgcgctgg cagcctagcc
11941 gccgggcctt ggaagctgcc ggcggttccc cctacgtgga ggaggtggac gatgaggagg
12001 aggagggcga gtacctggaa gactgatggc gcgaccgtat ttttgctaga tgcagcaaca
12061 gccaccgccg cctcctgatc ccgcgatgcg ggcggcgctg cagagccagc cgtccggcat
12121 taactcctcg gacgattgga cccaggccat gcaacgcatc atggcgctga cgacccgcaa
12181 tcccgaagcc tttagacagc agcctcaggc caaccgactc tcggccatcc tggaggccgt
12241 ggtgccctcg cgctcgaacc ccacgcacga gaaggtgctg gccatcgtga acgcgctggt
12301 ggagaacaag gccatccgcg gcgacgaggc cgggctggtg tacaacgcgc tgctggagcg
12361 cgtggcccgc tacaacagca ccaacgtgca gacgaacctg gaccgcatgg tgaccgacgt
12421 gcgcgaggcg gtgtcgcagc gcgagcggtt ccaccgcgag tcgaacctgg gctccatggt
12481 ggcgctgaac gccttcctga gcacgcagcc cgccaacgtg ccccggggcc aggaggacta
12541 caccaacttc atcagcgcgc tgcggctgat ggtggccgag gtgccccaga gcgaggtgta
12601 ccagtcgggg ccggactact tcttccagac cagtcgccag ggcttgcaga ccgtgaacct
12661 gagccaggct ttcaagaact gcagggact gtggggcgtg caggcccgg tcggggaccg
12721 cgcgacggtg tcgagcctgc tgacgccgaa ctcgcgcctg ctgctgctgc tggtggcgcc
12781 cttcacggac agcggcagcg tgagccgcga ctcgtacctg gctacctgc ttaacctgta
12841 ccgcgaggcc atcgggcagg cgcacgtgga cgagcagacc taccaggaga tcacccacgt
12901 gagccgcgcg ctgggccagg aggacccggg caacctggag gccaccctga acttctgct
12961 gaccaaccgg tcgcagaaga tcccgcccca gtacgcgctg agcaccgagg aggagcgcat
13021 cctgcgctac gtgcagcaga gcgtggggct gttcctgatg caggaggggg ccacgcccag
13081 cgccgcgctc gacatgaccg cgcgcaacat ggagcccagc atgtacgccc gcaaccgccc
13141 gttcatcaat aagctgatgg actacttgca tcgggcggcc gccatgaact cggactactt
13201 taccaacgcc atcttgaacc cgcactggct cccgccgccc gggttctaca cgggcgagta
13261 cgacatgccc gaccccaacg acgggttcct gtgggacgac gtggacagca gcgtgttctc
13321 gccgcgcccc accaccacca ccgtgtggaa gaaagagggc ggggaccggc ggccgtcctc
13381 ggcgctgtcc ggtcgcgcgg gtgctgccgc ggcggtgccc gaggccgcca gccccttccc
13441 gagcctgccc ttttcgctga cagcgtgcg cagcagcgag ctgggtcggc tgacgcggcc
13501 gcgcctgctg ggcgaggagg agtacctgaa cgactccttg cttcggcccg agcgcgagaa
13561 gaacttcccc aataacggga tagagagcct ggtggacaag atgagccgct ggaagacgta
13621 cgcgcacgag cacagggacg agccccgagc tagcagcagc accggcgcca cccgtagacg
13681 ccagcggcac gacaggcagc ggggtctggt gtgggacgat gaggattccg ccgacgacag
13741 cagcgtgttg gacttgggtg ggagtggtgg tggtaacccg ttcgctcacc tgcgcccccg
13801 tatcgggcgc ctgatgtaag aatctgaaaa aataaaagac ggtactcacc aaggccatgg
13861 cgaccagcgt gcgttcttct ctgttgtttg tagtagtatg atgaggcgcg tgtacccgga
```

FIG. 9D

```
13921 ggtcctcct ccctcgtacg agagcgtgat gcagcaggcg gtggcggcgg cgatgcagcc
13981 cccgctggag gcgccttacg tgcccccgcg gtacctggcg cctacgagg ggcggaacag
14041 cattcgttac tcggagctgg cacccttgta cgataccacc cggttgtacc tggtggacaa
14101 caagtcggcg gacatcgcct cgctgaacta ccagaacgac cacagcaact tcctgaccac
14161 cgtggtgcag aacaacgatt tcaccccac ggaggccagc acccagacca tcaactttga
14221 cgagcgctcg cggtggggcg gccagctgaa aaccatcatg cacaccaaca tgcccaacgt
14281 gaacgagttc atgtacagca caagttcaa ggcgcgggtg atggtctcgc gcaagacccc
14341 caacggggtc acagtaacag atggtagtca ggacgagctg acctacgagt gggtggagtt
14401 tgagctgccc gagggcaact tctcggtgac catgaccatc gatctgatga caacgccat
14461 catcgacaac tacttggcgg tggggcggca gaacggggtg ctggagagcg catcggcgt
14521 gaagttcgac acgcgcaact tccggctggg ctgggacccc gtgaccgagc tggtgatgcc
14581 gggcgtgtac accaacgagg ccttccaccc cgacatcgtc ctgctgcccg gctgcggcgt
14641 ggacttcacc gagagccgcc tcagcaacct gctgggcatc cgcaagcggc agcccttcca
14701 ggagggcttc cagatcctgt acgaggacct ggaggggggc aacatcccg cgctgctgga
14761 cgtggacgcc tacgagaaaa gcaaggagga tagcgccgcc gcggcgaccg cagccgtggc
14821 caccgcctct accgaggtgc ggggcgataa ttttgctagc gccgcgacac tggcagcggc
14881 cgaggcggct gaaaccgaaa gtaagatagt gatccagccg gtggagaagg acagcaagga
14941 ggaggagctac aacgtgctcg cggacaagaa aaacaccgcc taccgcagct ggtacctggc
15001 ctacaactac ggcgaccccg agaagggcgt gcgctcctgg acgctgctca ccacctcgga
15061 cgtcacctgc ggcgtggagc aagtctactg gtcgctgccc gacatgatgc aagacccggt
15121 caccttccgc tccacgcgtc aagttagcaa ctaccggtg gtgggcgccg agctcctgcc
15181 cgtctactcc aagagcttct tcaacgagca ggccgtctac tcgcagcagc tgcgcgcctt
15241 cacctcgctc acgcacgtct tcaaccgctt ccccgagaac cagatcctcg ttcgcccgcc
15301 cgcgcccacc attaccaccg tcagtgaaaa cgttcctgct ctcacagatc acgggaccct
15361 gccgctgcgc agcagtatcc ggggagtcca gcgcgtgacc gtcactgacg ccagacgccg
15421 cacctgcccc tacgtctaca aggccctggg cgtagtcgcg ccgcgcgtcc tctcgagccg
15481 caccttctaa aaaatgtcca ttctcatctc gcccagtaat aacaccggtt ggggcctgcg
15541 cgcgcccagc aagatgtacg gaggcgctcg ccaacgctcc acgcaacacc ccgtgcgcgt
15601 gcgcgggcac ttccgcgctc cctggggcgc cctcaagggc cgcgtgcgct cgcgcaccac
15661 cgtcgacgac gtgatcgacc aggtggtggc cgacgcgcgc aactacacgc ccgccgccgc
15721 gcccgtctcc accgtggacg ccgtcatcga cagcgtggtg gccgacgcgc gccggtacgc
15781 ccgcgccaag agccggcggc ggcgcatcgc ccggcggcac cggagcaccc ccgccatgcg
15841 cgcggcgcga gccttgctgc gcagggccag gcgcacggga cgcagggcca tgctcagggc
15901 ggccagacgc gcggcctccg gcagcagcag cgccggcagg acccgcagac gcgcggccac
15961 ggcggcggcg gcggccatcg ccagcatgtc ccgcccgcgg gcggcaacg tgtactgggt
16021 gcgcgacgcc gccaccggtg tgcgcgtgcc cgtgcgcacc cgccccctc gcacttgaag
16081 atgctgactt cgcgatgttg atgtgtccca gcggcgagga ggatgtccaa gcgcaaattc
16141 aaggaagaga tgctccaggt catcgcgcct gagatctacg gcccggcggc ggtgaaggag
16201 gaaagaaagc cccgcaaact gaagcgggtc aaaaaggaca aaaaggagga ggaagatgtg
16261 gacggactgg tggagtttgt gcgcgagttc gccccccggc ggcgcgtgca gtggcgcggg
16321 cggaaagtga accggtgct gcgaccccgg accacggtgg tcttcacgcc cggcgagcgt
16381 tccggctccg cctccaagcg ctcctacgac gaggtgtacg gggacgagga catcctcgag
16441 caggcggccg aacgtctggg cgagtttgct taccggcaagc gcagccgccc cgcgcccttg
16501 aaagaggagg cggtgtccat cccgctggac cacggcaacc ccacgccgag cctgaagccg
16561 gtgaccctgc agcaggtgct gcctggtgcg gcgccgcgcc ggggcttcaa gcgcgagggc
16621 ggcgaggatc tgtacccgac catgcagctg atggtgccca agccagaa gctggaggac
16681 gtgctggagc acatgaaggt ggacccgag gtgcagcccg aggtcaaggt gcggcccatc
16741 aagcaggtgg ccccgggcct gggcgtgcag accgtggaca tcaagatccc cacggagccc
16801 atggaaacgc agaccgagcc cgtgaagccc agcaccagca ccatggaggt gcagacggat
16861 ccctggatgc cggcaccggc ttccaccacc cgccgaagac gcaagtacgg cgcggccagc
16921 ctgctgatgc ccaactacgc gctgcatcct ccatcatcc ccacgccggg ctaccgcggc
16981 acgcgcttct accgcggcta caccagcagc cgccgccgca agaccaccac ccgccgccgc
17041 cgtcgtcgca cccgccgcag cagcaccgcg actccgccg ccgccctggt cggagagtg
17101 taccgcagcg ggcgcgagcc tctgaccctg ccgcgcgcgc gctaccaccc gagcatcgcc
17161 atttaactac cgcctcctac ttgcagatat ggccctcaca tgccgcctcc gcgtccccat
17221 tacgggctac cgaggaagaa agccgcgccg taaggctg acggggaacg ggctgcgtcg
17281 ccatcaccac cggcggcggc gcgcatcag caagcggttg ggggaggct cctgcccgc
17341 gctgatgccc atcatcgccg cggcgatcgg ggcgatcccc ggcatagctt ccgtggcggt
```

FIG. 9E

```
17401 gcaggcctct cagcgccact gagacacagc ttggaaaatt tgtaataaaa aatggactga
17461 cgctcctggt cctgtgatgt gtgttttttag atggaagaca tcaattttttc gtccctggca
17521 ccgcgacacg gcacgcggcc gtttatgggc acctggagcg acatcggcaa cagccaactg
17581 aacgggggcg ccttcaattg gagcagtctc tggagcgggc ttaagaattt cgggtccacg
17641 ctcaaaacct atggcaacaa ggcgtggaac agcagcacag ggcaggcgct gagggaaaag
17701 ctgaaagagc agaacttcca gcagaaggtg gtcgatggcc tggcctcggg catcaacggg
17761 gtggtggacc tggccaacca ggccgtgcag aaacagatca acagccgcct ggacgcggtc
17821 ccgcccgcgg ggtccgtgga gatgccccag gtggaggagg agctgcctcc cctggacaag
17881 cgcggcgaca agcgaccgcg tcccgacgcg gaggagacgc tgctgacgca cacggacgag
17941 ccgcccccgt acgaggaggc ggtgaaactg ggtctgccca ccacgcggcc cgtggcgcct
18001 ctggccaccg gggtgctgaa acccagcagc agcagcagcc agcccgcgac cctggacttg
18061 cctccgcctg cttcccgccc ctccacagtg gctaagcccc tgccgccggt ggccgtcgcg
18121 tcgcgcgccc ccgaggccg ccccaggcg aactggcaga gcactctgaa cagcatcgtg
18181 ggtctgggag tgcagagtgt gaagcgccgc cgctgctatt aaaagacact gtagcgctta
18241 acttgcttgt ctgtgtgtat atgtatgtcc gccgaccaga aggaggagga gaggcgcgt
18301 cgccgagttg caagatggcc accccatcga tgctgcccca gtgggcgtac atgcacatcg
18361 ccggacagga cgcttcggag tacctgagtc cgggtctggt gcagttcgcc cgcgccacag
18421 acacctactt cagtctgggg aacaagttta ggaaccccac ggtggcgccc acgcacgatg
18481 tgaccaccga ccgcagccag cggctgacgc tgcgcttcgt gcccgtggac cgcgaggaca
18541 acacctactc gtacaaagtg cgctacacgc tggccgtggg cgacaaccgc gtgctggaca
18601 tggccagcac ctactttgac atccgcggcg tgctggatcg gggccctagc ttcaaaccct
18661 actccggcac cgcttacaac agcctggctc caagggagc gcccaacact gccagtgga
18721 catataaagc tgatggtgat actggtacag aaaaaaccta tacatatgga aatgcgcctg
18781 tgcaaggcat tagtattaca aagatggta ttcaacttgg aactgacact gatgatcagc
18841 ccatttatgc agataaaact tatcaaccag gccctcaagt gggtgatgct gaatggcatg
18901 acatcactgg tactgatgaa aaatatggag gcagagctct caagcctgac accaaaatga
18961 agccctgcta tggttctttt gccaagccta ccaataaaga aggaggtcag gcaaatgtga
19021 aaaccgaaac aggcggtacc aaagaatatg acattgacat ggcattcttc gataatcgaa
19081 gtgcagctgc ggctggcctg gccccagaaa ttgttttgta tactgagaat gtggatctgg
19141 aaactccaga tactcatatt gtatacaagg cgggcacaga tgacagcagc tcttctatca
19201 attttgggtca gcagtccatg cccaacgac ccaactacat tggctttaga gacaacttta
19261 tcgggctcat gtactacaac agcactggca catgggcgt gctggctggt caggcctccc
19321 agctgaatgc tgtggtggac ttgcaggaca gaaacactga actgtcctac cagctcttgc
19381 ttgactctct gggcgacaga accaggtatt tcagtatgtg gaatcaggcg gtggacagct
19441 atgaccccga tgtgcgcatt attgaaaatc acggtgtgga ggatgaactc cctaactatt
19501 gcttccccct ggatgctgtg ggtagaactg atacttacca gggaattaag gccaatggtg
19561 ctgatcaaac cacctggacc aaagatgata ctgttaatga tgctaatgaa ttgggcaagg
19621 gcaatccttt cgccatggag atcaacatcc aggccaacct gtggcggaac ttcctctacg
19681 cgaacgtggc gctgtacctg cccgactcct acaagtacac gccggccaac atcacgctgc
19741 cgaccaacac caacacctac gattacatga acggccgcgt ggtggcgccc tcgctggtgg
19801 acgcctacat caacatcggg gcgcgctggt cgctggaccc catggacaac gtcaacccct
19861 tcaaccacca ccgcaacgcg ggcctgcgct accgctccat gctcctgggc aacgggcgct
19921 acgtgccctt ccacatccag gtgccccaaa agttcttcgc catcaagagc ctcctgctcc
19981 tgcccgggtc ctacacctac gagtggaact tccgcaagga cgtcaacatg atcctgcaga
20041 gctccctcgg caacgacctg cgcacggacg gggcctccat cgccttcacc agcatcaacc
20101 tctacgccac cttcttcccc atggcgcaca cacccgcctc cacgctcgag gccatgctgc
20161 gcaacgacac caacgaccag tccttcaacg actacctctc ggcggccaac atgctctacc
20221 ccatcccggc caacgccacc aacgtgccca tctccatccc ctcgcgcaac tgggccgcct
20281 tccgcggatg gtccttcacg cgcctcaaga cccgcgagac gccctcgctc ggctccgggt
20341 tcgaccccta cttcgtctac tcgggctcca tccctaccttcgacggcacc ttctacctca
20401 accacacctt caagaaggtc tccatcacct tgactcctc gtcagctggg cccggcaacg
20461 accgcctcct gacgcccaac gagttcgaaa tcaagcgcac gtcgacgga gaggggtaca
20521 acgtggccca gtgcaacatg accaaggact ggttcctggt ccagatgctg gcccactaca
20581 acatcggcta ccagggcttc tacgtgcccg aggggctaca aggaccgcatg tactccttct
20641 tccgcaactt ccagcccatg agccgccagg tcgtggacga ggtcaactac aaggactacc
20701 aggccgtcac cctggcctac cagcacaaca actcgggctt cgtcggctac ctcgcgccca
20761 ccatgcgcca gggacagccc taccccgcca actaccccta cccgctcatc ggcaagagcg
20821 ccgtcgccag cgtcacccag aaaagttcc tctgcgaccg ggtcatgtgg cgcatcccct
```

FIG. 9F

```
20881 tctccagcaa cttcatgtcc atgggcgcgc tcaccgacct cggccagaac atgctctacg
20941 ccaactccgc ccacgcgcta gacatgaatt tcgaagtcga ccccatggat gagtccaccc
21001 ttctctatgt tgtcttcgaa gtcttcgacg tcgtccgagt gcaccagccc caccgcggcg
21061 tcatcgaggc cgtctacctg cgcacgccct tctcggccgg caacgccacc acctaagccc
21121 cgctcttgct tcttgcaaga tgacggcctg tgcgggctcc ggcgagcagg agctcagggc
21181 catcctccgc gacctgggct gcgggccctg cttcctgggc accttcgaca agcgcttccc
21241 gggattcatg gccccgcaca agctggcctg cgccatcgtc aacacggccg gccgcgagac
21301 cggggggcgag cactggctgg ccttcgcctg gaaccccgcgc tcccacacct gctacctctt
21361 cgacccccttc gggttctcgg acgagcgcct caagcagatc taccagttcg agtacgaggg
21421 cctgctgcgc cgcagcgccc tggccaccga ggaccgctgc gtcaccctgg aaaagtccac
21481 ccagaccgtg cagggtccgc gctcggccgc ctgcgggctc ttctgctgca tgttcctgca
21541 cgccttcgtg cactggcccg accgccccat ggacaagaac cccaccatga acttgctgac
21601 gggggtgccc aacggcatgc tccagtcgcc caggtggaa cccaccctgc gccgcaacca
21661 ggaggcgctc taccgcttcc tcaacgccca ctccgcctac tttcgctccc accgcgcgcg
21721 catcgagaag gccaccgcct cgaccgcat gaatcaagac atgtaaaccg tgtgtgtatg
21781 tgaatgcttt attcataata aacagcacat gtttatgcca ccttttctga ggctctgact
21841 ttatttagaa atcgaagggg ttctgccggc tctcggcgtg ccccgcgggc agggatacgt
21901 tgcggaactg gtacttgggc agccacttga actcggggat cagcagcttc ggcacgggga
21961 ggtcggggaa cgagtcgctc cacagcttgc gcgtgagttg cagggcgccc agcaggtcgg
22021 gcgcggagat cttgaaatcg cagttgggac ccgcgttctg cgcgcgggag ttgcggtaca
22081 cggggttgca gcactggaac accatcaggg ccgggtgctt cacgctcgcc agcaccgtcg
22141 cgtcggtgat gccctccacg tccagatcct cggcgttggc catcccgaag gggtcatct
22201 tgcaggtctg ccgccccatg ctgggcacgc agccggcctt gtggttgcaa tcgcagtgca
22261 gggggatcag catcatctgg gcctgctcgg agctcatgcc cgggtacatg gccttcatga
22321 aagcctccag ctggcggaag gcctgctgcg ccttccgcc ctcggtgaag aagaccccgc
22381 aggacttgct agagaactgg ttggtggcgc agccggcgtc gtgcacgcag cagcgcgcgt
22441 cgttgttggc cagctgcacc acgctgcgcc ccagcggtt ctgggtgatc ttggcccggt
22501 cggggttctc cttcagcgcg cgctgcccgt tctcgctcgc cacatccatc tcgatcgtgt
22561 gctccttctg gatcatcacg gtcccgtgca ggcatcgcag cttgccctcg gcctcggtgc
22621 acccgtgcag ccacagcgcg cagccggtgc actcccagtt cttgtgggcg atctgggagt
22681 gcgagtgcac gaagccctgc aggaagcggc ccatcatcgt ggtcagggtc ttgttgctgg
22741 tgaaggtcag cgggatgccg cggtgctcct cgttcacata caggtggcag atgcggcggt
22801 acacctcgcc ctgctcgggc atcagctgga aggcggactt caggtcgctc tccacgcggt
22861 accggtccat cagcagcgtc atgacttcca tgcccttctc ccaggccgag acgatcggca
22921 ggctcagggg gttcttcacc gccgttgtca tcttagtcgc cgccgctgag gtcaggggggt
22981 cgttctcgtc cagggtctca aacactcgct tgccgtcctt tcggtgatg cgcacggggg
23041 gaaagctgaa gcccacggcc gccagctcct cctcggcctg cctttcgtcc tcgctgtcct
23101 ggctgatgtc ttgcaaaggc acatgcttgg tcttgcgggg ttttcttttttg ggcggcagag
23161 gcggcggcgg agacgtgctg ggcgagcgcg agttctcgct caccacgact atttcttctt
23221 cttggccgtc gtccgagacc acgcggcggt aggcatgcct cttctgggc agaggcggag
23281 gcgacgggct ctcgcggttc ggcggcggc tggcagagcc ccttccgcgt cgggggtgc
23341 gctcctggcg gcgctgctct gactgacttc ctccgcggcc ggccattgtg ttctcctagg
23401 gagcaacaag catggagact cagccatcgt cgccaacatc gccatctgcc cccgccgccg
23461 ccgacgagaa ccagcagcag aatgaaagct taaccgcccc gccgcccagc cccacctccg
23521 acgccgccgc ggccccagac atgcaagaga tggaggaatc catcgagatt gacctgggct
23581 acgtgacgcc cgcggagcac gaggaggagc tggcagcgcg cttttcagcc ccggaagaga
23641 accaccaaga gcagccagag caggaagcag agagcgagca gcagcaggct gggctcgagc
23701 atggcgacta cctgagcggg gcagaggacg tgctcatcaa gcatctggcc cgccaatgca
23761 tcatcgtcaa ggacgcgctg ctcgaccgcg ccgaggtgcc cctcagcgtg gcggagctca
23821 gccgcgccta cgagcgcaac ctcttctcgc gcgcgtgcc cccaagcgc cagcccaacg
23881 gcacctgcga gccaacccg cgcctcaact ctacccggt cttcgcggtg cccgaggccc
23941 tggccaccta ccacctcttt tcaagaacc aaggatccc cgtctcctgc cgcgccaacc
24001 gcacccgcgc cgacgccctg ctcaacctgg tcccggcgc ccgcctacct gatatcgcct
24061 ccttggaaga ggttcccaag atcttcgagg gtctgggcag cgacgagact cgggccgcga
24121 acgctctgca aggaagcgga gaggagcatg agcaccacag cgccctggtg gagttggaag
24181 gcgacaacgc gcgcctggcg gtgctcaagc gcacggtcga gctgacccac ttcgcctacc
24241 cggcgctcaa cctgcccccc aaggtcatga gcgccgtcat ggaccaggtg ctcatcaagc
24301 gcgcctcgcc cctctcggat gaggacatgc aggacccga gagctcggac gagggcaagc
```

FIG. 9G

```
24361  ccgtggtcag cgacgagcag ctggcgcgct ggctgggagc gagtagcacc ccccagagct
24421  tggaagagcg gcgcaagctc atgatggccg tggtcctggt gaccgtggag ctggagtgtc
24481  tgcgccgctt cttcgccgac gcagagaccc tgcgcaaggt cgaggagaac ctgcactacc
24541  tcttcaggca cgggtttgtg cgccaggcct gcaagatctc caacgtggag ctgaccaacc
24601  tggtctccta catgggcatc ctgcacgaga accgcctggg gcagaacgtg ctgcacacca
24661  ccctgcgcgg ggaggcccgc cgcgactaca tccgcgactg cgtctacctg tacctctgcc
24721  acacctggca gacgggcatg ggcgtgtggc agcagtgcct ggaggagcag aacctgaaag
24781  agctctgcaa gctcctgcag aagaacctga aggccctgtg gaccgggttc gacgagcgca
24841  ccaccgcctc ggacctggcc gacctcatct tccccgagcg cctgcggctg acgctgcgca
24901  acggactgcc cgactttatg agtcaaagca tgttgcaaaa ctttcgctct ttcatcctcg
24961  aacgctccgg gatcctgccc gccacctgct ccgcgctgcc ctcggacttc gtgccgctga
25021  ccttccgcga gtgcccccg ccgctctgga gccactgcta cctgctgcgc ctggccaact
25081  acctggccta ccactcggac gtgatcgagg acgtcagcgg cgagggtctg ctcgagtgcc
25141  actgccgctg caacctctgc acgccgcacc gctccctggc ctgcaacccc agctgctga
25201  gcgagaccca gatcatcggc accttcgagt tgcaaggccc cggcgagggc aagggggggtc
25261  tgaaactcac cccggggctg tggacctcgg cctacttgcg caagttcgtg cccgaggact
25321  accatccctt cgagatcagg ttctacgagg accaatccca gccgccaag gccgaactgt
25381  cggcctgcgt catcacccag ggggccatcc tggcccaatt gcaagccatc cagaaatccc
25441  gccaagaatt tctgctgaaa aagggccacg gggtctacct ggaccccag accggagagg
25501  agctcaaccc cagcttcccc caggatgccc cgaggaagca gcaagaagct gaaagtggag
25561  ctgccgccgc cggaggattt ggaggaagac tgggagagca gtcaggcaga ggaggaggag
25621  atggaagact gggacagcac tcaggcagag gaggacagcc tgcaagacag tctggaagac
25681  gaggtggagg aggaggcaga ggaagaagca gccgccgcca gaccgtcgtc ctcggcggag
25741  aaagcaagca gcacggatac catctccgct ccgggtcggg gtcgcggcga ccgggcccac
25801  agtaggtggg acgagaccgg gcgcttcccg aacccccacca cccagaccgg taagaaggag
25861  cggcagggat acaagtcctg gcggggcac aaaaacgcca tcgtctcctg cttgcaagcc
25921  tgcgggggca acatctcctt cacccgccgc tacctgctct ccaccgcgg ggtgaacttc
25981  ccccgcaaca tcttgcatta ctaccgtcac ctccacagcc cctactactg tttccaagaa
26041  gaggcagaaa cccagcagca gcagaaaacc agcggcagca gcagctagaa aatccacagc
26101  ggcggcaggt ggactgagga tcgcagcgaa cgagccggcg cagacccggg agctgaggaa
26161  ccggatcttt cccaccctct atgccatctt ccagcagagt cgggggcagg agcaggaact
26221  gaaagtcaag aaccgttctc tgcgctcgct cacccgcagt tgtctgtatc acaagagcga
26281  agaccaactt cagcgcactc tcgaggacgc cgaggctctc ttcaacaagt actgcgcgct
26341  cactcttaaa gagtagcccg cgccgccca cacgggaaa aaggcgggaa ttacgtcacc
26401  acctgcgccc ttcgcccgac catcatcatg agcaaagaga ttcccacgcc ttacatgtgg
26461  agctaccagc ccagatgggg cctggccgcc ggcgccgccc aggactactc cacccgcatg
26521  aactggctca gcgccgggcc cgcgatgatc tcacgggtga atgacatccg cgcccgccga
26581  aaccagatac tcctagaaca gtcagcgatc accgccacgc cccgccatca ccttaatccg
26641  cgtaattggc ccgccgccct ggtgtaccag gaaattcccc agcccacgac cgtactactt
26701  ccgcgagacg cccaggccga agtccagctg actaactcag gtgtccagct ggccggcggc
26761  gccgccctgt gtcgtcaccg ccccgctcag ggtataaagc ggctggtgat ccgaggcaga
26821  ggcacacagc tcaacgacga ggtggtgagc tcttcgctgg gtctgcgacc tgacggagtc
26881  ttccaactcg ccggatcggg gagatcttcc ttcacgcctc gtcaggccgt cctgactttg
26941  gagagttcgt cctcgcagcc ccgctcgggt ggcatcggca ctctccagtt cgtggaggag
27001  ttcactccct cggtctactt caacccttc tccggctccc ccggccacta cccggacgag
27061  ttcatcccga acttcgacgc catcagcgag tcggtggacg gctacgattg aatgtcccat
27121  ggtggcgcag ctgacctagc tcggcttcga cacctggacc actgtcgcct ctcctacgag
27181  ctcctgcagc agcgccagaa gttcacctgc ctggtcggag tcaaccccat cgtcatcacc
27241  cagcagtcgg gcgataccaa ggggtgcatc cactgctcct gcgcccatcc cgactgcgtc
27301  cacactctga tcaagaccct ctgcggcctc cgcgacctcc tcccatgaa ctaatcaccc
27361  ccttatccag tgaaataaag atcatattga tgatttgagt ttaataaaaa taagaatca
27421  cttacttgaa atctgatacc aggtctctgt ccatgttttc tgccaacacc acttcactcc
27481  cctcttccca gctctggtac tgcaggcccc gcgggctgc aaacttcctc cacacctga
27541  aggggatgtc aaattcctcc tgtccctcaa tcttcatttt atcttctatc agatgtccaa
27601  aaagcgcgtc cgggtggatg atgacttcga ccccgtctac ccctacgatg cagacaacgc
27661  accgaccgtg ccctcatca accccccctt cgtctcttca gatggattcc aagagaagcc
27721  cctggggggtg ctgtccctgc gtctggccga tcccgtcacc accaagaacg gggaaatcac
27781  cctcaagctg ggagatggggg tggacctcga ctcctcggga aaactcatct ccaacacggc
```

FIG. 9H

```
27841 caccaaggcc gccgcccctc tcagttttc caacaacacc atttcccta acatggatac
27901 ccctttttac aacaacaatg gaaagttagg catgaaagtc actgctccac tgaagatact
27961 agacacagac ttgctaaaaa cacttgttgt agcttatgga caaggtttag gaacaaacac
28021 cactggtgcc cttgttgccc aactagcatc cccacttgct tttgatagca atagcaaaat
28081 tgcccttaat ttaggcaatg gaccattgaa agtggatgca aatagactga acatcaattg
28141 caatagagga ctctatgtta ctaccacaaa agatgcactg gaagccaata taagttgggc
28201 taatgctatg acatttatag gaatgccat gggtgtcaat attgatacac aaaaaggctt
28261 gcaatttggc accactagta ccgtcgcaga tgttaaaaac gcttacccca tacaaatcaa
28321 acttggagct ggtctcacat tgacagcac aggtgcaatt gttgcatgga acaaagatga
28381 tgacaagctt acactatgga ccacagccga ccctctcca aattgtcaca tatattctga
28441 aaaggatgct aagcttacac tttgcttgac aaagtgtggc agtcagattc tgggcactgt
28501 ttccctcata gctgttgata ctggcagttt aaatcccata acaggaacag taaccactgc
28561 tcttgtctca cttaaattcg atgcaaatgg agttttgcaa agcagctcaa cactagactc
28621 agactattgg aatttcagac agggagatgt tacacctgct gaagcctata ctaatgctat
28681 aggtttcatg cccaatctaa aagcataccc taaaaacaca agtggagctg caaaaagtca
28741 cattgttggg aaagtgtacc tacatgggga tacaggcaaa ccactggacc tcattattac
28801 tttcaatgaa acaagtgatg aatcttgcac ttactgtatt aactttcaat ggcagtgggg
28861 ggctgatcaa tataaaaatg aaacacttgc cgtcagttca ttcacctttt cctatattgc
28921 taaagaataa accccactct gtacccatc tctgtctatg gaaaaaactc tgaaacacaa
28981 aataaaataa agttcaagtg ttttattgat tcaacagttt tacaggattc gagcagttat
29041 ttttcctcca ccctcccagg acatggaata caccaccctc tccccccgca cagccttgaa
29101 catctgaatg ccattggtga tggacatgct tttggtctcc acgttccaca cagtttcaga
29161 gcgagccagt ctcgggtcgg tcagggagat gaaaccctcc gggcactccc gcatctgcac
29221 ctcacagctc aacagctgag gattgtcctc ggtggtcggg atcacggtta tctggaagaa
29281 gcagaagagc ggcggtggga atcatagtcc gcgaacggga tcggccggtg tgtcgcatc
29341 aggccccgca gcagtcgctg tcgccgccgc tccgtcaagc tgctgctcag ggggtccggg
29401 tccagggact ccctcagcat gatgcccacg gccctcagca tcagtcgtct ggtgcggcgg
29461 gcgcagcagc gcatgcggat ctcgctcagg tcgctgcagt acgtgcaaca caggaccacc
29521 aggttgttca acagtccata gttcaacacg ctccagccga aactcatcgc gggaaggatg
29581 ctacccacgt ggccgtcgta ccagatcctc aggtaaatca agtggcgccc cctccagaac
29641 acgctgccca tgtacatgat ctccttgggc atgtggcggt tcaccacctc ccggtaccac
29701 atcaccctct ggttgaacat gcagccccgg atgatcctgc ggaaccacag ggccagcacc
29761 gccccgcccg ccatgcagcg aagagacccc gggtcccgac aatggcaatg gaggacccac
29821 cgctcgtacc cgtggatcat ctgggagctg aacaagtcta tgttggcaca gcacaggcat
29881 atgctcatgc atctcttcag cactctcagc tcctcggggg tcaaaaccat atcccagggc
29941 acggggaact cttgcaggac agcgaacccc gcagaacagg gcaatcctcg cacataactt
30001 acattgtgca tggacagggt atcgcaatca ggcagcaccg ggtgatcctc caccagagaa
30061 gcgcgggtct cggtctcctc acagcgtggt aaggggccg gccgatacgg gtgatggcgg
30121 gacgcggctg atcgtgttcg cgaccgtgtt atgatgcagt tgctttcgga cattttcgta
30181 cttgctgtag cagaacctgg tccgggcgct gcacaccgat cgccggcggc ggtcccggcg
30241 cttggaacgc tcggtgttga agttgtaaaa cagccactct ctcagaccgt gcagcagatc
30301 tagggcctca ggagtgatga agatccatc atgcctgatg gctctaatca catcgaccac
30361 cgtggaatgg gccagaccca gccagatgat gcaattttgt tgggtttcgg tgacggcggg
30421 ggagggaaga acaggaagaa ccatgattaa cttttaatcc aaacggtctc ggagcacttc
30481 aaaatgaaga tcgcggagat ggcacctctc gccccgctg tgttggtgga aaataacagc
30541 caggtcaaag gtgatacggt tctcgagatg ttccacggtg gcttccagca aagcctccac
30601 gcgcacatcc agaaacaaga caatagcgaa agcgggaggg ttctctaatt cctcaatcat
30661 catgttacac tcctgcacca tcccagata atttcattt ttccagcctt gaatgattcg
30721 aactagttcc tgaggtaaat ccaagccagc catgataaag agctcgcgca gagcgccctc
30781 caccggcatt cttaagcaca ccctcataat tccaagatat tctgctcctg gttcacctgc
30841 agcagattga caagcggaat atcaaaatct ctgccgcgat ccctaagctc ctccctcagc
30901 aataactgta agtactcttt catatcctct ccgaaatttt tagccatagg accaccagga
30961 ataagattag ggcaagccac agtacagata aaccgaagtc ctccccagtg agcattgcca
31021 aatgcaagac tgctataagc atgctggcta gacccggtga tatcttccag ataactggac
31081 agaaaatcgc ccaggcaatt tttaagaaaa tcaacaaaag aaaaatcctc caggtgcacg
31141 tttagagcct cgggaacaac gatggagtaa atgcaagcgg tgcgttccag catggttagt
31201 tagctgatct gtagaaaaaa acaaaaatga acattaaacc atgctagcct ggcgaacagg
31261 tgggtaaatc gttctctcca gcaccaggca ggccacgggg tctccggcac gaccctcgta
```

FIG. 91

```
31321 aaaattgtcg ctatgattga aaaccatcac agagagacgt tcccggtggc cggcgtgaat
31381 gattcgacaa gatgaataca cccccggaac attggcgtcc gcgagtgaaa aaaagcgccc
31441 aaggaagcaa taaggcacta caatgctcag tctcaagtcc agcaaagcga tgccatgcgg
31501 atgaagcaca aaattctcag gtgcgtacaa aatgtaatta ctcccctcct gcacaggcag
31561 caaagccccc gatccctcca ggtacacata caaagcctca gcgtccatag cttaccgagc
31621 agcagcacac aacaggcgca agagtcagag aaaggctgag ctctaacctg tccacccgct
31681 ctctgctcaa tatatagccc agatctacac tgacgtaaag gccaaagtct aaaaataccc
31741 gccaaataat cacacacgcc cagcacacgc ccagaaaccg gtgacacact caaaaaaata
31801 cgcgcacttc ctcaaacgcc caaactgccg tcatttccgg gttcccacgc tacgtcatca
31861 aaattcgact ttcaaattcc gtcgaccgtt aaaaacgtcg cccgcccgc ccctaacggt
31921 cgccgctccc gcagccaatc accgccccgc atccccaaat tcaaatacct catttgcata
31981 ttaacgcgca ccaaaagttt gaggtatatt attgatgatg   (SEQ ID NO: 5)
```

FIG. 9J

```
   1  ATGAAGCGCA CCAAAACGTC TGACGAGAGC TTCAACCCCG TGTACCCCTA TGACACGGAA
  61  AGCGGCCCTC CCTCCGTCCC TTTCCTCACC CCTCCCTTCG TGTCTCCCGA TGGATTCCAA
 121  GAAAGTCCCC CCGGGGTCCT GTCTCTGAAC CTGGCCGAGC CCCTGGTCAC TTCCCACGGC
 181  ATGCTCGCCC TGAAAATGGG AAGTGGCCTC TCCCTGGACG ACGCTGGCAA CCTCACCTCT
 241  CAAGATATCA CCACCGCTAG CCCTCCCCTC AAAAAAACCA AGACCAACCT CAGCCTAGAA
 301  ACCTCATCCC CCTAACTGT GAGCACCTCA GGCGCCCTCA CCGTAGCAGC CGCCGCTCCC
 361  CTGGCGGTGG CCGGCACCTC CCTCACCATG CAATCAGAGG CCCCCCTGAC AGTACAGGAT
 421  GCAAAACTCA CCCTGGCCAC CAAAGGCCCC CTGACCGTGT CTGAAGGCAA ACTGGCCTTG
 481  CAAACATCGG CCCCGCTGAC GGCCGCTGAC AGCAGCACCC TCACAGTCAG TGCCACACCA
 541  CCCCTTAGCA CAAGCAATGG CAGCTTGGGT ATTGACATGC AAGCCCCCAT TTACACCACC
 601  AATGGAAAAC TAGGACTTAA CTTTGGCGCT CCCCTGCATG TGGTAGACAG CCTAAATGCA
 661  CTGACTGTAG TTACTGGCCA AGGTCTTACG ATAAACGGAA CAGCCCTACA AACTAGAGTC
 721  TCAGGTGCCC TCAACTATGA CACATCAGGA AACCTAGAAT TGAGAGCTGC AGGGGGTATG
 781  CGAGTTGATG CAAATGGTCA ACTTATCCTT GATGTAGCTT ACCCATTTGA TGCACAAAAC
 841  AATCTCAGCC TTAGGCTTGG ACAGGGACCC CTGTTTGTTA ACTCTGCCCA CAACTTGGAT
 901  GTTAACTACA ACAGAGGCCT CTACCTGTTC ACATCTGGAA ATACCAAAAA GCTAGAAGTT
 961  AATATCAAAA CAGCCAAGGG TCTCATTTAT GATGACACTG CTATAGCAAT CAATGCGGGT
1021  GATGGGCTAC AGTTTGACTC AGGCTCAGAT ACAAATCCAT TAAAAACTAA ACTTGGATTA
1081  GGACTGGATT ATGACTCCAG CAGAGCCATA ATTGCTAAAC TGGGAACTGG CCTAAGCTTT
1141  GACAACACAG GTGCCATCAC AGTAGGCAAC AAAAATGATG ACAAGCTCAC CTTGTGGACC
1201  ACACCAGACC CATCTCCTAA CTGTAGAATC TATTCAGAGA AAGATGCTAA ATTCACACTT
1261  GTTTTGACTA AATGCGGCAG TCAGGTGTTG GCCAGCGTTT CTGTTTTATC TGTAAAAGGT
1321  AGCCTTGCGC CCATCAGTGG CACAGTAACT AGTGCTCAGA TTGTCCTCAG ATTTGATGAA
1381  AATGGAGTTC TACTAAGCAA TTCTTCCCTT GACCCTCAAT ACTGAACTA CAGAAAAGGT
1441  GACCTTACAG AGGGCACTGC ATATACCAAC GCAGTGGGAT TTATGCCCAA CCTCACAGCA
1501  TACCCAAAAA CACAGAGCCA AACTGCTAAA AGCAACATTG TAAGTCAGGT TTACTTGAAT
1561  GGGGACAAAT CCAAACCCAT GACCCTCACC ATTACCCTCA ATGGAACTAA TGAAACAGGA
1621  GATGCCACAG TAAGCACTTA CTCCATGTCA TTCTCATGGA ACTGGAATGG AAGTAATTAC
1681  ATTAATGAAA CGTTCCAAAC CAACTCCTTC ACCTTCTCCT ACATCGCCCA AGAATAA
 (SEQ ID NO: 6)
```

FIG. 10

```
   1  ATGTCCAAAA AGCGCGTCCG GGTGGATGAT GACTTCGACC CCGTCTACCC CTACGATGCA
  61  GACAACGCAC CGACCGTGCC CTTCATCAAC CCCCCCTTCG TCTCTTCAGA TGGATTCCAA
 121  GAGAAGCCCC TGGGGGTGTT GTCCCTGCGA CTGGCCGACC CCGTCACCAC CAAGAACGGG
 181  GAAATCACCC TCAAGCTGGG AGAGGGGGTG GACCTCGATT CCTCGGGAAA ACTCATCTCC
 241  AACACGGCCA CCAAGGCCGC CGCCCCTCTC AGTTTTTCCA ACAACACCAT TTCCCTTAAC
 301  ATGGATCACC CCTTTTACAC TAAAGATGGA AAATTATCCT ACAAGTTTC TCCACCATTA
 361  AATATACTGA GAACAAGCAT TCTAAACACA CTAGCTTTAG GTTTTGGATC AGGTTTAGGA
 421  CTCCGTGGCT CTGCCTTGGC AGTACAGTTA GTCTCTCCAC TTACATTTGA TACTGATGGA
 481  AACATAAAGC TTACCTTAGA CAGAGGTTTG CATGTTACAA CAGGAGATGC AATTGAAAGC
 541  AACATAAGCT GGGCTAAAGG TTTAAAATTT GAAGATGGAG CCATAGCAAC AACATTGGA
 601  AATGGGTTAG AGTTTGGAAG CAGTAGTACA GAAACAGGTG TTGATGATGC TTACCCAATC
 661  CAAGTTAAAC TTGGATCTGG CCTTAGCTTT GACAGTACAG GAGCCATAAT GGCTGGTAAC
 721  AAAGAAGACG ATAAACTCAC TTTGTGGACA ACACCTGATC CATCACCAAA CTGTCAAATA
 781  CTCGCAGAAA ATGATGCAAA ACTAACACTT GCTTGACTA AATGTGGTAG TCAAATACTG
 841  GCCACTGTGT CAGTCTTAGT TGTAGGAAGT GGAAACCTAA ACCCCATTAC TGGCACCGTA
 901  AGCAGTGCTC AGGTGTTTCT ACGTTTGAT GCAAACGGTG TTCTTTTAAC AGAACATTCT
 961  ACACTAAAAA AATACTGGGG GTATAGGCAG GGAGATAGCA TAGATGGCAC TCCATATACC
1021  AATGCTGTAG GATTCATGCC CAATTTAAAA GCTTATCCAA AGTCACAAAG TTCTACTACT
1081  AAAAATAATA TAGTAGGGCA AGTATACATG AATGGAGATG TTTCAAAACC TATGCTTCTC
1141  ACTATAACCC TCAATGGTAC TGATGACAGC AACAGTACAT ATTCAATGTC ATTTTCATAC
1201  ACCTGGACTA ATGGAAGCTA TGTTGGAGCA ACATTTGGGG CTAACTCTTA TACCTTCTCA
1261  TACATCGCCC AAGAATGA (SEQ ID NO: 7)
```

FIG. 11

```
   1 ATGTCCAAAA AGCGCGTCCG GGTGGATGAT GACTTCGACC CCGTCTACCC CTACGATGCA
  61 GACAACGCAC CGACCGTGCC CTTCATCAAC CCCCCCTTCG TCTCTTCAGA TGGATTCCAA
 121 GAGAAGCCCC TGGGGGTGCT GTCCCTGCGT CTGGCCGATC CCGTCACCAC CAAGAACGGG
 181 GAAATCACCC TCAAGCTGGG AGATGGGGTG GACCTCGACG ACTCGGGAAA ACTCATCTCC
 241 AACACGGCCA CCAAGGCCGC CGCCCCTCTC AGTTTTTCCA ACAACACCAT TTCCCTTAAC
 301 ATGGATACCC CTCTTTACAA CAACAATGGA AAGCTAGGTA TGAAGGTAAC CGCACCATTA
 361 AAGATATTAG ACACAGATCT ACTAAAAACA CTTGTTGTTG CTTATGGGCA GGGATTAGGA
 421 ACAAACACCA ATGGTGCTCT TGTTGCCCAA CTAGCATACC CACTTGTTTT TAATACCGCT
 481 AGCAAAATTG CCCTTAATTT AGGCAATGGA CCATTAAAAG TGGATGCAAA TAGACTGAAC
 541 ATTAATTGCA AAGAGGTAT CTATGTCACT ACCACAAAAG ATGCACTGGA GATTAATATC
 601 AGTTGGGCAA ATGCTATGAC ATTTATAGGA AATGCCATTG GTGTCAATAT TGACACAAAA
 661 AAAGGCCTAC AGTTCGGCAC TTCAAGCACT GAAACAGATG TTAAAAATGC TTTTTCACTC
 721 CAAGTAAAAC TTGGAGCTGG TCTTACATTT GACAGCACAG GTGCCATTGT TGCTTGGAAC
 781 AAAGAAGATG ACAAACTTAC ACTGTGGACC ACAGCCGATC CATCTCCAAA CTGTCACATA
 841 TATTCTGCAA AGGATGCTAA GCTTACACTC TGCTTGACAA AGTGTGGTAG TCAAATCCTA
 901 GGCACTGTCT CCCTATTAGC AGTCAGTGGC AGCTTGGCTC CTATCACAGG GGCTGTTAGA
 961 ACTGCACTTG TATCACTCAA ATTCAATGCT AATGGAGCCC TTTTGGACAA ATCAACTCTG
1021 AACAAAGAAT ACTGAACTA CAGACAAGGA GATCTAATTC CAGGTACACC ATATACACAT
1081 GCTGTGGGTT TCATGCCTAA CAAAAAAGCC TACCCTAAAA ACACAACTGC AGCTTCCAAG
1141 AGCCACATTG TGGGTGATGT GTATTTAGAT GGAGATGCAG ATAAACCTTT ATCTCTTATC
1201 ATCACTTTCA ATGAAACTGA TGATGAAACC TGTGATTACT GCATCAACTT TCAATGGAAA
1261 TGGGGAGCTG ATCAATATAA GGATAAGACA CTCGCAACCA GTTCATTCAC CTTCTCATAC
1321 ATCGCCCAAG AATAA    (SEQ ID NO: 8)
```

FIG. 12

```
   1 ATGTCCAAAA AGCGCGTCCG GGTGGATGAT GACTTCGACC CCGTCTACCC CTACGATGCA
  61 GACAACGCAC CGACCGTGCC CTTCATCAAC CCCCCCTTCG TCTCTTCAGA TGGATTCCAA
 121 GAGAAGCCCC TGGGGGTGCT GTCCCTGCGA CTGGCCGACC CCGTCACCAC CAAGAACGGG
 181 GAAATCACCC TCAAGCTGGG AGAGGGGGTG GACCTCGACT CCTCGGGAAA ACTCATCTCC
 241 AACACGGCCA CCAAGGCCGC CGCCCCTCTC AGTTTTTCCA ACAACACCAT TTCCCTTAAC
 301 ATGGATACCC CTTTTTACAA CAATAATGGA AAGTTAGGCA TGAAAGTCAC TGCTCCACTG
 361 AAGATACTCG ACACAGACTT GCTAAAAACA CTTGTTGTAG CTTATGGACA AGGTTTAGGA
 421 ACAAACACCA CTGGTGCCCT TGTTGCCCAA CTAGCAGCCC CACTTGCTTT TGATAGCAAT
 481 AGCAAAATTG CCCTTAATTT AGGCAATGGA CCATTGAAAG TGGATGCAAA TAGACTGAAC
 541 ATCAATTGCA ATAGAGGACT CTATGTTACT ACCACAAAAG ATGCACTGGA AACCAACATA
 601 AGTTGGGCTA ATGCTATGAC ATTTATAGGA AATGCCATGG TGTCAATAT TGATACACAA
 661 AAAGGCTTGC AATTTGGCAC CACTAGTACC GTCGCAGATG TTAAAAACGC TTACCCCATA
 721 CAAGTCAAAC TGGGAGCTGG TCTCACATTT GACAGCACAG GTGCAATTGT CGCTTGGAAC
 781 AAAGAAGATG ACAAACTTAC ACTGTGGACC ACAGCCGATC CATCTCCAAA CTGTCACATA
 841 TATTCTGACA AGGATGCTAA GCTTACACTC TGCTTGACAA AGTGTGGCAG TCAGATACTG
 901 GGCACTGTTT CTCTCATAGC TGTTGATACT GGTAGCTTAA ATCCAATAAC AGGACAAGTA
 961 ACCACTGCTC TTGTTTCACT TAAATTCGAT GCCAATGGAG TTTTGCAAAC CAGTTCAACA
1021 TTGGACAAAG AATATTGGAA TTTTAGAAAA GGAGATGTGA CACCTGCTGA GCCATATACT
1081 AATGCTATAG GTTTCATGCC CAATCTAAAG GCATACCCTA AAACACAAG TGGAGCTGCA
1141 AAAGTCACA TTGTTGGGAA AGTGTACCTA CATGGGGATA CAGACAAACC ACTGGACCTG
1201 ATTATTACTT TCAATGAAAC AAGTGATGAA TCTTGCACTT ACTGTATTAA CTTTCAATGG
1261 AAATGGGATA GTACTAAGTA CACAGGTGAA ACACTTGCTA CAAGCTCCTT CACCTTCTCC
1321 TACATTGCCC AAGAATGA    (SEQ ID NO: 9)
```

FIG. 13

```
  1  ATGTCCAAAA AGCGCGTCCG GGTGGATGAT GACTTCGACC CCGTCTACCC CTACGATGCA
 61  GACAACGCAC CGACCGTGCC CTTCATCAAC CCCCCCTTCG TCTCTTCAGA TGGATTCCAA
121  GAGAAGCCCC TGGGGGTGTT GTCCCTGCGA CTGGCCGACC CCGTCACCAC CAAGAACGGG
181  GAAATCACCC TCAAGCTGGG AGAGGGGGTG GACCTCGACT CCTCGGGAAA ACTCATCTCC
241  AACACGGCCA CCAAGGCCGC TGCCCCTCTC AGTTTTTCCA ACAACACCAT TTCCCTTAAC
301  ATGGATCACC CCTTTTACAC TAAAGATGGA AAATTAGCCT ACAAGTTTC TCCACCATTA
361  AATATACTGA GAACAAGCAT TCTAAACACA CTAGCTTTAG GTTTTGGATC AGGTTTAGGA
421  CTCCGTGGCT CTGCCTTGGC AGTACAGTTA GTCTCTCCAC TTACATTTGA TACTGATGGA
481  AACATAAAGC TTACCTTAGA CAGAGTTTG CATGTTACAA CAGGAGATGC AATTGAAAGC
541  AACATAAGCT GGGCTAAAGG TTTAAAATTT GAAGATGGAG CCATAGCAAC CAACATTGGA
601  AATGGGTTAG AGTTTGGAAG CAGTAGTACA GAAACAGGTG TCGATGATGC TTACCCAATC
661  CAAGTTAAAC TTGGATCTGG CCTTAGCTTT GACAGTACAG GAGCCATAAT GGCTGGTAAC
721  AAAGAAGACG ATAAACTCAC TTTGTGGACA ACACCTGATC CATCACCAAA CTGTCAAATA
781  CTCGCAGAAA ATGATGCAAA ACTAACACTT TGCTTGACTA AATGTGGTAG TCAAATACTG
841  GCCACTGTGT CAGTCTTAGT TGTAGGAAGT GGAGACCTAA ACCCCATTAC TGGCACCGTA
901  AGCAGTGCTC AGGTGTTTCT ACGTTTTGAT GCAAACGGTG TTCTTTTAAC AGAACATTCT
961  ACACTAAAAA AATACTGGGG GTATAGGCAG GGAGATAGCA TAGATGGCAC TCCATATGCC
1021 AATGCTGTAG GATTCATGCC CAATTTAAAA GCTTATCCAA AGTCACAAAG TTCTACTACT
1081 AAAAATAATA TAGTAGGGCA AGTATACATG AATGGAGATG TTTCAAAACC TATGCTTCTC
1141 ACTATAACCC TCAATGGTAC TGATGACAGC AACAGTACAT ATTCAATGTC ATTTTCATAC
1201 ACCTGGACTA ATGGAAGCTA TGTTGGAGCA ACATTTGGAG CTAACTCTTA TACCTTCTCC
1261 TACATCGCCC AAGAATGA  (SEQ ID NO: 10)
```

FIG. 14

```
  1  ATGTCCAAAA AGCGCGTCCG GGTGGATGAT GACTTCGACC CCGTCTACCC CTACGATGCA
 61  GACAACGCAC CGACCGTGCC CTTCATCAAC CCCCCCTTCG TCTCTTCAGA TGGATTCCAA
121  GAGAAGCCCC TGGGGGTGCT GTCCCTGCGA CTGGCCGACC CCGTCACCAC CAAGAACGGG
181  GAAATCACCC TCAAGCTGGG AGAGGGGGTG GACCTCGACT CCTCGGGAAA ACTCATCTCC
241  AACACGGCCA CCAAGGCCGC CGCCCCTCTC AGTTTTTCCA ACAACACCAT TTCCCTTAAC
301  ATGGATCACC CCTTTTACAC TAAAGATGGA AAATTATCCT ACAAGTTTC TCCACCATTA
361  AATATACTGA GAACAAGCAT TCTAAACACA CTAGCTTTAG GTTTTGGATC AGGTTTAGGA
421  CTCCGTGGCT CTGCCTTGGC AGTACAGTTA GTCTCTCCAC TTACATTTGA TACTGATGGA
481  AACATAAAGC TTACCTTAGA CAGAGTTTG CATGTTACAA CAGGAGATGC AATTGAAAGC
541  AACATAAGCT GGGCTAAAGG TTTAAAATTT GAAGATGGAG CCATAGCAAC CAACATTGGA
601  AATGGGTTAG AGTTTGGAAG CAGTAGTACA GAAACAGGTG TTGATGATGC TTACCCAATC
661  CAAGTTAAAC TTGGATCTGG CCTTAGCTTT GACAGTACAG GAGCCATAAT GGCTGGTAAC
721  AAAGAAGACG ATAAACTCAC TTTGTGGACA ACACCTGATC CATCGCCAAA CTGTCAAATA
781  CTCGCAGAAA ATGATGCAAA ACTAACACTT TGCTTGACTA AATGTGGTAG TCAAATACTG
841  GCCACTGTGT CAGTCTTAGT TGTAGGAAGT GGAAACCTAA ACCCCATTAC TGGCACCGTA
901  AGCAGTGCTC AGGTGTTTCT ACGTTTTGAT GCAAACGGTG TTCTTTTAAC AGAACATTCT
961  ACACTAAAAA AATACTGGGG GTATAGGCAG GGAGATAGCA TAGATGGCAC TCCATATACC
1021 AATGCTGTAG GATTCATGCC CAATTTAAAA GCTTATCCAA AGTCACAAAG TTCTACTACT
1081 AAAAATAATA TAGTAGGGCA AGTATACATG AATGGAGATG TTTCAAAACC TATGCTTCTC
1141 ACTATAACCC TCAATGGTAC TGATGACAGC AACAGTACAT ATTCAATGTC ATTTTCATAC
1201 ACCTGGACTA ATGGAAGCTA TGTTGGAGCA ACATTTGGGG CTAACTCTTA TACCTTCTCA
1261 TACATCGCCC AAGAATGA  (SEQ ID NO: 11)
```

FIG. 15

```
   1  ATGAAGCGCA CCAAAACGTC TGACGAGAGC TTCAACCCCG TGTACCCCTA TGACACGGAA
  61  AACGGTCCTC CCTCCGTCCC TTTCCTCACC CCTCCCTTCG TGTCTCCCGA TGGATTCCAA
 121  GAGAGCCCCC CCGGGGTCCT GTCTCTGAAC CTGGCCGAGC CCTGGTCAC TTCCCACGGC
 181  ATGCTCGCCC TGAAAATGGG AAGTGGCCTC TCCCTGGACG ACGCCGGCAA CCTCACCTCT
 241  CAAGATGTCA CCACCACTAC CCCTCCCCTG AAAAAAACCA AGACCAACCT CAGCCTAGAA
 301  ACCTCAGCCC CCTGACTGT GAGCACCTCA GGCGCCCTCA CCCTAGCAGC CGCCGTTCCC
 361  CTGGCGGTGG CCGGCACCTC CCTCACCATG CAATCAGAGG CCCCCCTGAC AGTCCAAGAT
 421  GCAAAACTCA CCCTGGCCAC CAAGGGCCCC CTGACCGTGT CTGAAGGCAA ACTAGCCTTG
 481  CAGACCTCGG CCCCGCTGAC GGCCGCTGAC AGCAGCACCC TCACAATCAG CGCCACACCG
 541  CCCCTTAGCA CAAGCAATGG CAGCTTGGGT ATTGACATGC AAGCCCCCAT TTACACTACT
 601  AACGGAAAAC TGGGACTTAA CTTTGGTGCT CCCCTGCATG TGGTAGACAG CCTAAATGCA
 661  CTGACTGTAG TGACTGGCCA AGGTCTTACG ATAAACGGTA CAGCCCTACA AACTAGAGTC
 721  TCAGGTGCCC TCAACTATGA CTCATCAGGA AACCTAGAAT GAGAGCTGC AGGGGGTATG
 781  CGAGTTGATG CAAATGGCAA ACTTATCCTT GACGTAGCTT ACCCATTTGA TGCTCAAAAC
 841  AACCTCAGCC TTAGACTTGG ACAGGGACCC TGTTTGTTA ACTCTGCCCA CAACTTGGAT
 901  GTTAACTACA ACAGAGGCCT CTACCTGTTC ACATCTGGAA ATACCAAAAA GCTAGAAGTT
 961  AATATCAAAA CAGCCAAAGG CCTCATTTAT GATGACACTG CTATAGCAAT CAATCCAGGC
1021  GATGGGCTAG AGTTTGGCTC AGGCTCAGAT ACAAATCCAT TAAAAACTAA ACTTGGATTG
1081  GGACTAGAGT ATGACTCCAG CAGAGCCATA ATTGCTAAGC TGGGAACCGG CCTAAGCTTT
1141  GACAACACAG GTGCCATCAC AGTGGGCAAC AAAAATGATG ACAAGCTTAC CTTGTGGACC
1201  ACACCAGACC CCTCTCCCAA CTGTAGAATT TATTCAGAAA AAGATGCTAA ATTTACACTA
1261  GTTTTAACTA AATGCGGCAG TCAGGTGTTG GCCAGCGTTT CTGTTTATC TGTAAAGGC
1321  AGCCTTGCGC CCATCAGTGG CACAGTAACT AGCGCTCAGA TTATTCTCAG ATTTGATGAA
1381  AATGGAGTTC TACTAAGCAA TTCTTCTCTT GACCCCCAAT ACTGGAACTA CAGAAAAGGT
1441  GACCTTACAG AGGGCACTGC ATATACCAAC GCAGTGGGAT TTATGCCCAA CCTCACAGCA
1501  TACCCAAAAA CACAGAGTCA AACTGCTAAA AGCAACATTG TAAGCCAGGT TTACTTGAAT
1561  GGGGACAAAT CCAAACCCAT GATCCTCACC ATTACCCTCA ATGGAACTAA TGAAACAGGG
1621  GATGCTACAG TTAGCACTTA CTCCATGTCA TTCTCATGGA ATTGGAATGG AAGTAATTAC
1681  ATTAATGAAA CGTTCCAAAC CAACTCTTTC ACCTTCTCCT ACATCGCCCA AGAATAA
  (SEQ ID NO: 12)
```

FIG. 16

```
   1  ATGTCCAAAA AGCGCGTCCG GGTGGATGAT GACTTCGACC CCGTCTACCC CTACGATGCA
  61  GACAACGCAC CGACCGTGCC CTTCATCAAC CCCCCCTTCG TCTCTTCAGA TGGATTCCAA
 121  GAGAAGCCCC TGGGGGTGCT GTCCCTGCGA CTGGCTGACC CCGTCACCAC CAAGAACGGG
 181  GAAATCACCC TCAAGCTGGG AGAGGGGGTG GACCTCGACT CCTCGGGAAA ACTCATCTCC
 241  AACACGGCCA CCAAGGCCGC CGCCCCTCTC AGTTTTTCCA CAACACCAT TTCCCTTAAC
 301  ATGGATACCC CTTTTTACAC CAAAGATGGA AAATTAACCA TGCAGGTCAC TGCACCACTA
 361  AAGTTAGCAA ACACAGCCAT ATTGAACACA CTAGCTATGG CATATGGAAA TGGATTAGGT
 421  CTAAGCAACA ACGCTCTTAC CGTTCAGTTA CAATCTCCAC TCACCTTTAA CAACAGCAAG
 481  GTTGCAATCA ACCTGGGAAA TGGACCACTA ATGTAACAT CAAACAGACT TAGCATTAAT
 541  TGCAAGAGGG GTGTCTATGT CACCACCACA GGAGATGCAA TTGAAACCAA CATAAGTTGG
 601  TCAAATGCTA TTAAATTTAT AGGAAATGCC ATGGGTGTCA ACATTGATAC AAACAAAGGC
 661  TTGCAATTTG GCACCACCAG CACTGTCACA GATGTGACCA ATGCTTTCCC CATACAAGTC
 721  AAACTTGGGG CTGGTCTTGC ATTTGATAGC ACTGGAGCTA TTGTTGCATG GAACAAAGAG
 781  GATGACAGTC TCACTTTGTG GACTACACCA GATCCATCTC CAAATTGCAA GATAGCATCT
 841  GACAAAGATG CTAAACTCAC ACTTTGCTTG ACAAAATGTG GTAGTCAGAT ACTGGCACT
 901  GTCTCCTTGT TAGCTGTGAG TGGCAGTTTA GCTCCTATCA CTGGAGCTGT GAGCACTGCA
 961  CTTGTATCAC TTAAATTCGA TGCCAATGGA GCACTCTTGG AAAAATCAAC CCTAAACAGA
1021  GAATATTGGA ACTATAGACA AGGAGATCTT ATTCCAGGTA CGCCATATAC TCACGCAGTA
1081  GGTTTCATGC CCAACAAGAA AGCCTACCCT AAAAACACAA CTGCAGCTTC CAAAAGCCAC
1141  ATTGTGGGAG AAGTCTATCT AGACGGAGAT GCAGATAAGC CCTATCTCT CATAATCACT
1201  TTTAATGAAA CTGATGATGA ATCATGTGAC TATTGCATGA ACTTTCAATG GAAATGGGGT
1261  GCTGATCAAT ACAAGGACAA AACACTCGCT ACCAGCTCCT TCACCTTCTC CTACATTGCC
1321  CAAGAATGA   (SEQ ID NO: 13)
```

FIG. 17

```
   1  ATGAAGCGCA CCAAAACGTC TGACGAGAGC TTCAACCCCG TGTACCCCTA TGACACGGAA
  61  AGCGGCCCTC CCTCCGTCCC TTTCCTCACC CCTCCCTTCG TGTCTCCCGA TGGATTCCAA
 121  GAAAGCCCCC CCGGGGTCCT GTCTCTGAAC CTGGCCGAGC CCCTGGTCAC TTCCCACGGC
 181  ATGCTTGCCC TGAAAATGGG AAGTGGCCTC TCCCTGGACG ACGCTGGCAA CCTTACCTCT
 241  CAAGATATTA CCTCCACTAC CCCTCCCCTC AAAAAAACCA AGACCAACCT CAGCCTAGAA
 301  ACCTCATCCC CCTAACTGT AAGCACCTCA GGCGCCCTCA CCGTAGCAGC CGCCGCTCCC
 361  CTGGCGGTGG CCGGCACCTC CCTCACCATG CAATCAGAGG CCCCCCTGGC AGTACAGGAT
 421  GCAAAACTCA CCCTGGCCAC CAAAGGCCCC CTGACCGTGT CTGAAGGCAA ACTGGCCTTG
 481  CAAACATCGG CCCCGCTGAC GGCCGCTGAC AGCAGCACCC TCACCGTTAG CTCCACTCCA
 541  CCAATTAGTG TAAGCAGTGG AAGTTTGGGC TTGGACATGG AAGACCCCAT GTATACTCAC
 601  GATGGAAAAC TGGGAATAAG AATTGGGGGT CCACTAAGAG TAGTAGACAG CTTGCACACA
 661  CTCACTGTAG TTACCGGAAA TGGACTAACT GTAGATAACA ATGCCCTCCA AACTAGAGTT
 721  ACGGGCGCCC TAGGTTATGA CACATCAGGA AATCTACAAC TGAGAGCCGC AGGGGGTATG
 781  CGAATTGATG CAAATGGCCA ACTTATCCTT GATGTGGCAT ACCCATTTGA TGCTCAAAAC
 841  AATCTCAGCC TTAGACTTGG TCAGGGACCC CTGTATGTAA ATACAGACCA CAACCTGGAT
 901  TTAAATTGCA ACAGAGGTCT AACCACAACT ACCACCAACA ACACAAAAAA ACTTGAGACT
 961  AAAATTAGCT CAGGCTTAGA CTATGACACC AATGGTGCTG TCATTATTAA ACTTGGCACT
1021  GGTCTAAGCT TCGACAACAC AGGCGCCCTA ACTGTGGGAA ACACTGGTGA TGATAAACTG
1081  ACTCTGTGGA CGACCCCAGA CCCATCTCCA AATTGCAGAA TTCACTCAGA CAAAGACTGC
1141  AAGTTTACTC TCGTCCTAAC TAAGTGTGGA AGCCAAATCC TGGCCTCTGT CGCCGCCCTA
1201  GCGGTATCAG GAAATCTGGC TTCGATAACA GGCACCGTTG CCAGCGTTAC CATCTTTCTT
1261  AGATTTGATC AGAATGGAGT GCTTATGGAA AACTCCTCAC TAGACAAGCA GTACTGGAAC
1321  TTCAGAAATG GCAATTCAAC TAATGCTGCC CCTACACCA ACGCAGTTGG GTTCATGCCA
1381  AACCTCGCAG CGTACCCCAA AACGCAAAGC CAGACTGCTA AAAACAACAT TGTAAGTCAG
1441  GTTTACTTGA ATGGAGACAA ATCCAAACCC ATGACCCTTA CCATCACCCT CAATGGAACT
1501  AATGAATCCA GTGAAACTAG TCAGGTGAGT CACTACTCCA TGTCATTTAC ATGGGCTTGG
1561  GAAAGCGGGC AATATGCCAC TGAAACCTTT GCCACCAACT CCTTCACCTT TTCTTACATT
1621  GCTGAACAAT AA (SEQ ID NO: 14)
```

FIG. 18

```
   1 ATGAAGCGCA CCAAAACGTC TGACAAGAGC TTCAACCCCG TGTACCCCTA TGACACGGAA
  61 AACGGTCCTC CCTCCGTCCC TTTCCTCACC CCTCCCTTCG TGTCTCCCGA TGGATTCCAA
 121 GAGAGCCCCC CCGGGGTCCT GTCTCTGAAC CTGGCCGAGC CCCTGGTCAC TTCCCACGGC
 181 ATGCTCGCCC TGAAAATGGG AAGTGGCCTC TCCCTGGACG ACGCCGGCAA CCTCACCTCT
 241 CAAGATGTCA CCACCACTAC CCCTCCCCTG AAAAAAACCA AGACCAACCT CAGCCTAGAA
 301 ACCTCAGCCC CCTGACTGT GAGCACCTCA GGCGCCCTCA CCCTAGCAGC CGCCGCCCCC
 361 CTGGCGGTGG CCGGCACCTC CCTCACCATG CAATCAGAGG CCCCCCTGAC AGTCCAAGAT
 421 GCAAAACTCA CCCTGGCCAC CAAGGGCCCC CTGACCGTGT CTGAAGGCAA ACTGGCCTTG
 481 CAGACCTCGG CCCCGCTGAC GGCCGCTGAC AGCAGCACCC TCACCGTTAG CGCCACACCA
 541 CCCATCAGTG TAAGCAGTGG AAGTTTGGGC TTAGACATGG AAGACCCAAT GTATACTCAT
 601 GATGGAAAAC TGGGAATAAG AATTGGGGGC CCACTGAGAG TAGTAGACAG CCTGCACACA
 661 CTGACTGTAG TTACCGGAAA TGGAATAGCT GTAGATAACA ATGCCCTCCA AACTAGAGTT
 721 ACGGGCGCCC TGGGTTATGA CACATCAGGA ACCTACAAC TGAGAGCCGC GGGGGGTATG
 781 CGAATTGATG CAAATGGCCA ACTTATCCTT GATGTGGCAT ACCCATTTGA TGCTCAAAAC
 841 AATCTCAGCC TTAGACTTGG TCAGGGACCC CTGTATGTAA ACACAGACCA CAACCTAGAT
 901 TTGAATTGCA ACAGAGGTCT GACCACAACT ACCACCAACA ACACAAAAAA ACTTGAAACT
 961 AAAATTGGCT CAGGCTTAGA CTATGATACC AATGGTGCTG TTATTATTAA ACTTGGCACT
1021 GGTGTCAGCT TTGACAGCAC AGGTGCCCTA AGTGTGGGAA ACACTGGCGA TGATAAACTG
1081 ACTCTGTGGA CAACCCCAGA CCCATCTCCA AATTGCAGAA TTCACTCAGA CAAAGACTGC
1141 AAGTTTACTC TAGTCCTAAC TAAGTGTGGA AGTCAAATCC TGGCTTCTGT CGCCGCCCTA
1201 GCGGTGTCAG GAAATCTGGC TTCAATAACA GGCACCGTTT CCAGCGTTAC CATCTTTCTC
1261 AGATTTGATC AGAATGGAGT GCTTATGGAA AACTCCTCGC TAGACAAGCA GTACTGGAAC
1321 TTCAGAAATG GTAATTCAAC CAATGCCACC CCCTACACCA ATGCAGTTGG GTTTATGCCA
1381 AACCTCGCAG CATACCCCAA GACACAGAGC CAGACTGCAA AAACAACAT TGTAAGTCAG
1441 GTTTACTTGA ATGGGGACAA ATCCAAACCC ATGACCCTTA CCATTACCCT CAATGGAACT
1501 AATGAATCCA GTGAAACTAG CCAGGTGAGT CACTACTCCA TGTCATTTAC GTGGGCTTGG
1561 GAGAGTGGGC AATATGCCAC CGAAACCTTT GCCACCAATT CCTTTACCTT CTCTTACATT
1621 GCTGAACAAT AA   (SEQ ID NO: 15)
```

```
        201                                                                                              300
C1      ................ ................ ................ ................ ................ ................
CV68    KDGKLSLQVS PPLNILRTSI LNTLALGFGS ................ GLGLRG.SAL AVQLVSPLTF DTDGNIKLTL DRG....... .......... LHVTTGDAIE SNISWAKGLK
PAN5    NNGKLGMKVT APLKILDTDL LKTLVVAYGQ ................ GLGTNTTGAL VAQLASPLAF DSNSKIALNL GNGPLKVDAN RLNINCNRGL YVTTTKDALE ANISWANAMT
PAN6    NNGTLSLNVS TPLAVFPT.. FNTLGISLGN ................ GLQTSN.KLL TVQLTHPLTF SSNS.ITVKT DKG....... .......LY INSSGNRGLE ANISLKRGLV
PAN7    KDGKLSLQVS PPLNILKSTI LNTLAVAYGS ................ GLGLSGGTAL AVQLASPLAF DEKGNIKINL ASGPLTVDAS RLSINCKRGV TVTTSGDAIE SNISWPKGIR
CHAD3   HDGKLGIRIG GPLRVVDS.. LHTLTVVTGN ................ GLTVDN.NAL QTRVTGALGY DTSGNLQLRA AGGMRIDANG QLILN..... .......... VAYPFDAQNN LSLRLGQGPL
CHAD4   KDGKLSLQVS PPLNILRTSI LNTLALGFGS ................ GLGLRG.SAL AVQLVSPLTF DTDGNIKLTL DRG....... .......... LHVTTGDAIE SNISWAKGLK
CHAD5   NNGKLGMKVT APLKILDTDL LKTLVVAYGQ ................ GLGTNTNGAL VAQLAYPLVF NTASKIALNL GNGPLKVDAN RLNINCKRGI YVTTTKDALE INISWANAMT
CHAD6   NNGKLGMKVT APLKILDTDL LKTLVVAYGQ ................ GLGTNTNGAL VAQLAYPLVF NTASKIALNL GNGPLKVDAN RLNINCKRGI YVTTTKDALE INISWANAMT
CHAD7   NNGKLGMKVT APLKILDTDL LKTLVVAYGQ ................ GLGTNTTGAL VAQLAAPLAF DSNSKIALNL GNGPLKVDAN RLNINCNRGL YVTTTKDALE TNISWANAMT
CHAD8   ................ ................ ................ ................ ................ ................
CHAD9   KDGKLALQVS PPLNILRTSI LNTLALGFGS ................ GLGLRG.SAL AVQLVSPLTF DTDGNIKLTL DRG....... .......... LHVTTGDAIE SNISWAKGLK
CHAD10  KDGKLSLQVS PPLNILRTSI LNTLALGFGS ................ GLGLRG.SAL AVQLVSPLTF DTDGNIKLTL DRG....... .......... LHVTTGDAIE SNISWAKGLK
CHAD11  TNGKLGLNFG APLHVVDS.. LNALTVVTGN ................ GLTING.TAL QTRVSGALNY DSSGNLELRA AGGMRVDANG KLILD..... .......... VAYPFDAQNN LSLRLGQGPL
CHAD16  KDGKLTMQVT APLKLANTAI LNTLAMAYGN ................ GLGLSN.NAL TVQLQSPLTF NNSK.VAINL GNGPLNVTSN RLSINCKRGV YVTTTGDAIE TNISWSNAIK
CHAD17  HDGKLGIRIG GPLRVVDS.. LHTLTVVTGN ................ GLTVDN.NAL QTRVTGALGY DTSGNLQLRA AGGMRIDANG QLILD..... .......... VAYPFDAQNN LSLRLGQGPL
CHAD19  HDGKLGIRIG GPLRVVDS.. LHTLTVVTGN ................ GIAVDN.NAL QTRVTGALGY DTSGNLQLRA AGGMRIDANG QLILD..... .......... VAYPFDAQNN LSLRLGQGPL
CHAD20  TNGKLGLNFG APLHVVDS.. LNALTVVTGN ................ GLTING.TAL QTRVSGALNY DTSGNLELRA AGGMRVDANG QLILD..... .......... VAYPFDAQNN LSLRLGQGPL
CHAD22  KDDKLCLSLG DGLVTKDDKL CLSLG..... ................ .......... .......... .......... .......... .......... .......... ..........
CHAD24  HDGKLGIRIG GPLRVVDS.. LHTLTVVTGN ................ GIAVDN.NAL QTRVTGALGY DTSGNLQLRA AGGMRIDANG QLILD..... .......... VAYPFDAQNN LSLRLGQGPL
CHAD26  NNGKLGMKVT APLKILDTDL LKTLVVAYGQ ................ GLGTNTNGAL VAQLAYPLVF NTASKIALNL GNGPLKVDAN RLNINCKRGI YVTTTKDALE INISWANAMT
CHAD30  KDDKLCLSLG DGLVTKDDKL CLSLG..... ................ .......... .......... .......... .......... .......... .......... ..........
CHAD31  TNGKLGLNFG APLHVVDS.. LNALTVVTGN ................ GLTING.TAL QTRVSGALNY DTSGNLELRA AGGMRVDANG QLILD..... .......... VAYPFDAQNN LSLRLGQGPL
CHAD37  ................ ................ ................ ................ ................ ................
CHAD38  KDGKLSLQVS PPLNILKSTI LNTLAVAYGS ................ GLGLSGGTAL AVQLASPLTF DEKGNIKINL ASGPLTVDAS RLSINCKRGV TVTTAGDAIK SNISWPKGIR
CHAD44  NNGTLSLNVS TPLAVFPT.. FNTLGISLGN ................ GLQTSN.KLL TVQLTHPLTF SSNS.ITVKT DKG..LYIN. .......... ..SSGNRGLE ANISLKRGLV
CHAD63  KDGKLSLQVS PPLNILRTSI LNTLALGFGS ................ GLGLRG.SAL AVQLVSPLTF DTDGNIKLTL DRG....... .......... LHVTTGDAIE SNISWAKGLK
CHAD82  NNGKLGMKVT APLKILDTDL LKTLVVAYGQ ................ GLGTNTNGAL VAQLAYPLVF NTASKIALNL GNGPLKVDAN RLNINCKRGI YVTTTKDALE INISWANAMT
```

FIG. 20C

```
       301                                                                                                                                400
C1     ..........  ..........  ..........  ..........  ..........  ..........  ITSPLTKS  NHSIGLEWSD  GLQTNEAKLC  VKLGKGLVFD  SSSSAIAMEN.
CV68   FEDGAIATNI  G..NGLEFGS  SS........  ..........  ..........  ..........  ........  ..........  TE TGVDDAYPIQ  VKLGSGLSFD  STGAIMAGNK
PAN5   FIGNAMGVNI  DTQKGLQFGT  TS........  ..........  ..........  ..........  ........  .........TV  ADVKNAYPIQ  IKLGAGLTFD  STGAIVAWNK
PAN6   FDGNAIATYI  G..NGLDYGS  YDSDGKTRPV  I.........  ..........  ..........  ........  ..TKIGAG    LNFDANKAIA  VKLGTGLSFD  SAGALTAGNK
PAN7   FEGNGIAANI  G..RGLEFGT  TS........  ..........  ..........  ..........  ........  ..........  TE TDVTDAYPIQ  VKLGTGLTFD  STGAIVAMNK
CHAD3  YINTDHNLDL  NCNRGLTTTT  TNNTKKLET.  ..........  ..........  ..........  ........  ....KISSG  LDYDTNGAVI  IKLGTGLSFD  NTGALTVGNT
CHAD4  FEDGAIATNI  G..NGLEFGS  SS........  ..........  ..........  ..........  ........  ..........  TE TGVDDAYPIQ  VKLGSGLSFD  STGAIMAGNK
CHAD5  FIGNAIGVNI  DTKKGLQFGT  SS........  ..........  ..........  ..........  ........  ..........  TE TDVKNAFSLQ  VKLGAGLTFD  STGAIVAWNK
CHAD6  FIGNAIGVNI  DTKKGLQFGT  SS........  ..........  ..........  ..........  ........  ..........  TE TDVKNAFPLQ  VKLGAGLTFD  STGAIVAWNK
CHAD7  FIGNAMGVNI  DTQKGLQFGT  TS........  ..........  ..........  ..........  ........  .........TV  ADVKNAYPIQ  VKLGAGLTFD  STGAIVAWNK
CHAD8  ..........  ..........  ..........  ..........  ..........  ..........  ........  .........D  GLETKNNQLC  AKLGDGLTFN  TGSICIDTDI
CHAD9  FEDGAIATNI  G..NGLEFGS  SS........  ..........  ..........  ..........  ........  ..........  TE TGVDDAYPIQ  VKLGSGLSFD  STGAIMAGNK
CHAD10 FEDGAIATNI  G..NGLEFGS  SS........  ..........  ..........  ..........  ........  ..........  TE TGVDDAYPIQ  VKLGSGLSFD  STGAIMAGNK
CHAD11 FVNSAHNLDV  NYNRGLYLFT  SGNTKKLEVN  IKTAKGLIYD  DTAIAINPGD  GLEFGSGSDT  NPLKTKLGLG  LEYDSSRAII  TDVTNAFPIQ  AKLGTGLSFD  NTGAITVGNK
CHAD16 FIGNAMGVNI  DTNKGLQFGT  TS........  ..........  ..........  ..........  ........  .......TV  TDVTNAFPIQ  VKLGAGLAFD  STGAIVAWNK
CHAD17 YVNTDHNLDL  NCNRGLTTTT  TNNTKKLET.  ..........  ..........  ..........  ........  ....KISSG  LDYDTNGAVI  IKLGTGLSFD  NTGALTVGNT
CHAD19 YVNTDHNLDL  NCNRGLTTTT  TNNTKKLET.  ..........  ..........  ..........  ........  ....KIGSG  LDYDTNGAVI  IKLGTGVSFD  STGALSVGNT
CHAD20 FVNSAHNLDV  NYNRGLYLFT  SGNTKKLEVN  IKTAKGLIYD  DTAIAINAGD  GLQFDSGSDT  NPLKTKLGLG  KIGSG       LDYDSSRAII  AKLGTGLSFD  NTGAITVGNK
CHAD22 ..........  ..........  ..........  ..........  ..........  ..........  ........  .........D  GLITKDDTLC  AKLGHGLVFD  SSNAITIEN.
CHAD24 YVNTDHNLDL  NCNRGLTTTT  TNNTKKLET.  ..........  ..........  ..........  ........  ....KIGSG  LDYDTNGAVI  IKLGTGVSFD  STGALSVGNT
CHAD26 FIGNAIGVNI  DTKKGLQFGT  SS........  ..........  ..........  ..........  ........  ..........  TE TDVKNAFPLQ  VKLGAGLTFD  STGAIVAWNK
CHAD30 ..........  ..........  ..........  ..........  ..........  ..........  ........  .........D  GLITKDDTLC  AKLGHGLVFD  SSNAITIEN.
CHAD31 FVNSAHNLDV  NYNRGLYLFT  SGNTKKLEVN  IKTAKGLIYD  DTAIAINAGD  GLQFDSGSGDT  NPLKTKLGLG  LDYDSSRAII  AKLGTGLSFD  NTGAITVGNK
CHAD37 ..........  ..........  ..........  ..........  ..........  ..........  ........  .........D  GLETKENKLY  VKLGDGLKFS  SGSIYIDHDV
CHAD38 FEGDAIAAANI G..RGLEFGT  TS........  ..........  ..........  ..........  ........  ..........  TE TDVTDAYPIQ  VKLGTGLTFD  STGAIVAWNK
CHAD44 FDGNAIATYI  G..NGLDYGS  YDSDGKTRP.  ..........  ..........  ..........  ........  ..VTKIGAG  LNFDANKAIA  VKLGTGLSFD  SAGALTAGNK
CHAD63 FEDGAIATNI  G..NGLEFGS  SS........  ..........  ..........  ..........  ........  ..........  TE TGVDDAYPIQ  VKLGSGLSFD  STGAIMAGNK
CHAD82 FIGNAIGVNI  DTKKGLQFGT  SS........  ..........  ..........  ..........  ........  ..........  TE TDVKNAFPLQ  VKLGAGLTFD  STGAIVAWNK
```

```
        501                                                                         600
    C1  GTIT.SAKGF MPSTTAYPFI TYATQSLN.E DYIYGECYYK STNGTLFPLK VTVTLNRRMS AS....GMAY AMNFSWSLNA EEAPETTEVT LITSPFFFSY
   CV68 GTPYTNAVGF MPNLKAYP.. ..KSQSSTTK NNIVGQVYMN GD..VSKPML LTITLNGTDD SN....STY SMSFSYTWTN G...SYVGAT FGANSYTFSY
   PAN5 AEAYTNAIGF MPNLNAYP.. ..KNTSGAAK SHIVGKVYLH GD..TGKPLD ES....CTY CINFQWQWGA D...QYKNET LAVSSFTFSY
   PAN6 SVAYTNAVGF MPNIGAYP.. ..KTQSKTPK NSIVSQVYLT GE..TTMPMT KDTT.PVSTY SMTFTWQWTG D...YKDKNIT FATNSFSFSY
   PAN7 AEPYTNAIGF MPNIKAYP.. ..KNTSAASK SHIVSQVYLN GD..EAKPLM LIITFNETED AT....CTY SITFQWKMDS T...KYTGET LATSSFTFSY
  CHAD3 AAPYTNAVGF MPNLAAYP.. ..KTQSQTAK NNIVSQVYLN GD..KSKPMT SSETSQVSHY SMSFTWAWES G...QYATET FATNSFTFSY
  CHAD4 GTPYTNAVGF MPNLKAYP.. ..KSQSSTTK NNIVGQVYMN GD..VSKPML LTITLNGTDD SN....STY SMSFSYTWTN G...SYVGAT FGANSYTFSY
  CHAD5 GTPYTHAVGF MPNKKAYP.. ..KNTTAASK SHIVGDVYLD GD..ADKPLS LIITFNETDD ET....CDY CINFQWKWGA D...QYKDET LAVSSFTFSY
  CHAD6 ADPYTNAIGF MPNLNAYP.. ..KNTNAAAK SHIVGKVYLH GD..ESKPLD LIITFNETSD ES....CTY CINFQWQWGT D...QYKDET LAVSSFTFSY
  CHAD7 AEPYTNAIGF MPNLKAYP.. ..KNTSGAAK SHIVGKVYLH GD..TDKPLD LIITFNETSD ES....CTY CINFQWKWDS T...KYTGET LATSSFTFSY
  CHAD8 TADPNNCKSF MPSLNAYP.. ..LRPNGGNG NYIYGTTYYR ARDETLYELK TSVMLNYKIT SG....LCAY AMHFQWSWNS GTKPEDTPAT FIASPFVFSY
  CHAD9 GTPYANAVGF MPNLKAYP.. ..KSQSSTTK NNIVGQVYMN GD..VSKPML LTITLNGTDD SN....STY SMSFSYTWTN G...SYVGAT FGANSYTFSY
 CHAD10 GTPYTNAVGF MPNLKAYP.. ..KSQSSTTK NNIVGQVYMN GD..VSKPML LTITLNGTDD SN....STY SMSFSYTWTN G...SYVGAT FGANSYTFSY
 CHAD11 GTAYTNAVGF MPNLTAYP.. ..KTQSQTAK SNIVSQVYLN GD..KSKPMI LIITFNETDD TGD.ATVSTY SMSFSWNWNG S...NYINET FQTNSFTFSY
 CHAD16 GTPYTHAVGF MPNKKAYP.. ..KNTTAASK SHIVGEVYLD GD..ADKPLS LIITFNETDD ES....CDY CMNFQWKWGA D...QYKDET LATSSFTFSY
 CHAD17 AAPYTNAVGF MPNLAAYP.. ..KTQSQTAK NNIVSQVYLN GD..KSKPMT SSETSQVSHY SMSFTWAWES G...QYATET FATNSFTFSY
 CHAD19 ATPYTNAVGF MPNLAAYP.. ..KTQSQTAK NNIVSQVYLN GD..KSKPMT SSETSQVSHY SMSFTWAWES G...QYATET FATNSFTFSY
 CHAD20 GTAYTNAVGF MPNLTAYP.. ..KTQSQTAK SNIVSQVYLN GD..KSKPMT TGD.ATVSTY SMSFSWNWNG S...NYINET FQTNSFTFSY
 CHAD22 GTIT.SAKGF MPSTTAYPFI TYATQSLN.E DYIYGECYYK STNGTLFPLK VTVTLNRRMS ASG...MAY AMNFSWSLNA EEAPETTEVT LITSPFFFSY
 CHAD24 ATPYTNAVGF MPNLAAYP.. ..KTQSQTAK NNIVSQVYLN GDK..SKPMI LTITLNGTNE SSETSQVSHY SMSFTWAWES G...QYATET FATNSFTFSY
 CHAD26 GTPYTHAVGF MPNKKAYP.. ..KNTTAASK SHIVGDVYLD GD..ADKPLS LIITFNETDD ET....CDY CINFQWKWGA D...QYKDKT LATSSFTFSY
 CHAD30 GTIT.SAKGF MPSTTAYPFI TYATQSLN.E DYIYGECYYK STNGTLFPLK VTVTLNRRMS ASG...MAY AMNFSWSLNA EEAPETTEVT LITSPFFFSY
 CHAD31 GTAYTNAVGF MPNLTAYP.. ..KTQSQTAK SNIVSQVYLN GDK..SKPMT TG.DATVSTY SMSFSWNWNG S...NYINET FQTNSFTFSY
 CHAD37 SSEVSNCKGF MPSLNAYPFR NPTKPTKGRE DYIYGITYYQ ATDGNLYELK TTITLNHSVI SS....LCAY AMHISWSWDT VTEPETTPTT LITSPFSFSY
 CHAD38 AEPYTNAVGF MPNIKAYP.. ..KNTSAASK SHIVGKVYLN GD..ETKPLM LIITFNGTDE AT....CTY SITFQWKWDS T...KYTGKT LATSSFTFSY
 CHAD44 SVAYTNAVGF MPNIGAYP.. ..KTQSKTPK NSIVSQVYLT GET..TMPMT KDTTP.VSTY SMTFTWQWTG D...YKDKNIT FATNSFSFSY
 CHAD63 GTPYTNAVGF MPNLKAYP.. ..KSQSSTTK NNIVGQVYMN GD..VSKPML LTITLNGTDD SN....STY SMSFSYTWTN G...SYVGAT FGANSYTFSY
 CHAD82 ADPYTNAIGF MPNLNAYP.. ..KNTNAAAK SHIVGKVYLH GD..VSKPLD LIITFNETSD ES....CTY CINFQWRWGT D...QYKDET LAVSSFTFSY
```

FIG. 20F

| | 601 |
|---|---|
| C1 | IREDD |
| CV68 | IAQE. |
| PAN5 | IAKE. |
| PAN6 | IAQE. |
| PAN7 | IAQE. |
| CHAD3 | IAEQ. |
| CHAD4 | IAQE. |
| CHAD5 | IAQE. |
| CHAD6 | IAKE. |
| CHAD7 | IAQE. |
| CHAD8 | IREDD |
| CHAD9 | IAQE. |
| CHAD10 | IAQE. |
| CHAD11 | IAQE. |
| CHAD16 | IAEQ. |
| CHAD17 | IAQE. |
| CHAD19 | IAEQ. |
| CHAD20 | IAQE. |
| CHAD22 | IREDD |
| CHAD24 | IAEQ. |
| CHAD26 | IAQE. |
| CHAD30 | IREDD |
| CHAD31 | IAQE. |
| CHAD37 | IREDD |
| CHAD38 | IAQE. |
| CHAD44 | IAQE. |
| CHAD63 | IAQE. |
| CHAD82 | IAKE. |

FIG. 20G

```
   1 ATGGCGACCC CATCGATGAT GCCGCAGTGG TCGTACATGC ACATCTCGGG CCAGGACGCC
  61 TCGGAGTACC TGAGCCCCGG GCTGGTGCAG TTCGCCCGCG CCACCGAGAG CTACTTCAGC
 121 CTGAGTAACA AGTTTAGGAA CCCCACGGTG GCGCCCACGC ACGATGTGAC CACCGACCGG
 181 TCTCAGCGCC TGACGCTGCG GTTCATTCCC GTGGACCGCG AGGACACCGC GTACTCGTAC
 241 AAGGCGCGGT TCACCCTGGC CGTGGGCGAC AACCGCGTGC TGGACATGGC CTCCACCTAC
 301 TTTGACATCC GCGGGGTGCT GGACCGGGGT CCCACTTTCA GCCCTACTC TGGCACCGCC
 361 TACAACTCCC TGGCCCCCAA GGGCGCTCCC AACCCATGCG AGTGGGATGA GGCTGCTACT
 421 GCCCTTGACA TTGATTTGAA CGCAGAAGAC GATGAAGAAA GCGACGAAGC TCAAGGGGAA
 481 GCAGATCAGC AGAAAACTCA TGTATTTGGC CAGGCGCCCT ACTCCGGACA GAACATTACA
 541 AAAGAAGGCA TACAGATAGG CATAGATGCT GCCAGTCAAG CCCAGACACC TGTATATGCC
 601 GATAAAACAT TCCAACCAGA ACCTCAAGTT GGAGAATCAC AGTGGAATGA GACAGAGATT
 661 AGTTATGGAG CGGGACGGGT GCTTAAAAAA ACCACTCTCA TGAAACCTTG CTATGGGTCG
 721 TATGCAAGGC CTACTAATGA GAACGGAGGT CAGGGCATCC TCTTGGAACA AGATGGAAAG
 781 AAAGAAAGTC AAGTGGAAAT GCAATTTTTC TCTACTACTC AGGCAGCCGC GGGTAATTCA
 841 GATAATCCTA CCCCAAAGGT TGTTTTGTAC AGCGAGGATG TTAACCTGGA AACACCAGAT
 901 ACACACATTT CATACATGCC CACCAACAAC GAGACAAATT CAAGAGAGCT TTTGGGACAA
 961 CAGGCCATGC CCAACAGGCC TAATTACATT GGCTTCAGAG ACAACTTTAT CGGTCTCATG
1021 TATTACAACA GCACTGGCAA CATGGGAGTG CTTGCAGGTC AGGCTCTCA GTTGAACGCA
1081 GTGGTGGACT TGCAAGACAG AAACACAGAA CTGTCATACC AGCTCTTGCT TGATTCCATG
1141 GGTGACAGAA CCAGATACTT TTCCATGTGG AATCAGGCAG TGGACAGTTA TGACCCAGAT
1201 GTCAGAATTA TTGAAAATCA TGGAACTGAA GACGAGCTCC CCAACTATTG TTTCCCTCTG
1261 GGCGGCGTAA TCAATACGGA AACTTTCACA AAAGTAAAAC CTAAAGCTGC ACAGGACGCT
1321 CAGTGGGAAA AAGATTCAGA ATTTTCAGAT AAAAATGAAA TAAGGGTGGG AAACAACTTC
1381 GCCATGGAAA TTAACCTCAA TGCCAATCTG TGGAGGAACT TTTTGTACTC CAACGTAGCC
1441 CTCTACTTGC CTGACAAGCT TAAGTATACT CCATCCAATG TGCAAATTTC CAACAATCCC
1501 AACTCCTACG ATTACATGAA CAAGCGAGTG GTGGCCCCGG GCTGGTGGA CTGCTACATC
1561 AACCTGGGCG CGCGCTGGTC GCTGGACTAC ATGGACAACG TCAACCCCTT CAACCACCAC
1621 CGCAATGCGG GCCTGCGCTA CCGCTCCATG CTCCTGGGCA ACGGGCGCTA CGTGCCCTTC
1681 CACATCCAGG TGCCCCAGAA GTTCTTTGCC ATCAAGAACC TCCTCCTCCT GCCGGGCTCC
1741 TACACCTACG AGTGGAACTT CAGGAAGGAT GTCAACATGG TCCTCCAGAG CTCTCTGGGT
1801 AACGATCTCA GGGTGGACGG GGCCAGCATC AAGTTCGAGA GCATCTGCCT CTACGCCACC
1861 TTCTTCCCCA TGGCCCACAA CACGGCCTCC ACGCTCGAGG CCATGCTCAG GAACGACACC
1921 AACGACCAGT CCTTCAATGA CTACCTTTCC GCCGCCAACA TGCTCTACCC CATACCCGCC
1981 AACGCCACCA ACGTCCCCAT CTCCATCCCC TCGCGCAACT GGGCGGCCTT CCGCGGCTGG
2041 GCCTTCACCC GCCTCAAGAC CAAGGAGACC CCCTCCCTGG GCTCGGGATT CGACCCCTAC
2101 TACACCTACT CGGGCTCCAT TCCCTACCTG GACGGCACCT TCTACCTCAA CCACACTTTC
2161 AAGAAGGTCT CGGTCACCTT CGACTCCTCG GTCAGCTGGC CGGGCAACGA CCGTCTGCTC
2221 ACCCCAACG AGTTCGAGAT CAAGCGCTCG GTCGACGGGG AGGGCTACAA CGTGGCCCAG
2281 TGCAACATGA CCAAGGACTG GTTCCTGGTC CAGATGCTGG CCAACTACAA CATCGGCTAC
2341 CAGGGCTTCT ACATCCCAGA GAGCTACAAG GACAGGATGT ACTCCTTCTT CAGGAACTTC
2401 CAGCCCATGA GCCGGCAGGT GGTGGACCAG ACCAAGTACA AGGACTACCA GGAGGTGGGC
2461 ATCATCCACC AGCACAACAA CTCGGGCTTC GTGGGCTACC TCGCCCCCAC CATGCGCGAG
2521 GGACAGGCCT ACCCCGCCAA CTTCCCCTAC CCGCTCATAG CAAGACCGC GGTCGACAGC
2581 ATCACCCAGA AAAGTTCCT CTGCGACCGC ACCCTCTGGC GCATCCCCTT CTCCAGCAAC
2641 TTCATGTCCA TGGGTGCGCT CTCGGACCTG GGCAGAACT TGCTCTACGC CAACTCCGCC
2701 CACGCCCTCG ACATGACCTT CGAGGTCGAC CCCATGGACG AGCCCACCCT TCTCTATGTT
2761 CTGTTCGAAG TCTTTGACGT GGTCCGGGTC CACCAGCCGC ACCGCGGCGT CATCGAGACC
2821 GTGTACCTGC GTACGCCCTT CTCGGCCGGC AACGCCACCA CCTAA (SEQ ID NO: 16)
```

FIG. 21

```
   1 ATGGCCACCC CATCGATGCT GCCCCAGTGG GCGTACATGC ACATCGCCGG ACAGGACGCT
  61 TCGGAGTACC TGAGTCCGGG TCTGGTGCAG TTCGCCCGCG CCACAGACAC CTACTTCAGT
 121 CTGGGGAACA AGTTTAGGAA CCCCACGGTG GCGCCCACGC ACGATGTGAC CACCGACCGC
 181 AGCCAGCGGC TGACGCTGCG CTTCGTGCCC GTGGACCGCG AGGACAACAC CTACTCGTAC
 241 AAAGTGCGCT ACACGCTGGC CGTGGGCGAC AACCGCGTGC TGGACATGGC CAGCACCTAC
 301 TTTGACATCC GCGGCGTGCT GGATCGGGGC CCTAGCTTCA ACCCTACTC CGGCACCGCC
 361 TACAACAGCC TGGCTCCCAA GGGAGCGCCC AATTCCAGCC AGTGGGAGCA AAAAAAGACT
 421 GGCAATAATG CCAATGGAGA TACGGAGAAT GTCACTTATG GTGTAGCTGC CATGGGAGGA
 481 ATTGACATCG ATAAAAATGG CCTTCAAATT GGAACCGATG ACACCAAAGA TGACGATAAT
 541 GAAATTTATG CAGACAAAAC ATATCAGCCT GAGCCGCAAA TAGGAGAGGA AAACTGGCAA
 601 GAAACATATT CCTACTATGG AGGTAGAGCT CTTAAAAAG ATACCAAAAT GAAGCCATGC
 661 TATGGCTCAT TGCCAGACC TACCAATGTG AAAGGAGGAC AGGCAAAAAT AAAAACAGAT
 721 GGAGATGTTA AGTCATTTGA CATAGACCTA GCCTTCTTTG ATATTCCCAA TTCTGGCGCG
 781 GGAAATGGCA CAAATGTTAA CGATGATCCA GATATGGTTA TGTATACAGA AAATGTAAAT
 841 CTGGAAACCC CAGATACTCA TATTGTGTAC AAACCAGGAA CTTCAGATGA CAGCTCAAAG
 901 GTCAACTTGT GTCAGCAATC CATGCCTAAC AGACCCAATT ATATTGGCTT CAGAGACAAT
 961 TTTATTGGGC TTATGTACTA CAACAGCACT GGCAATATGG GTGTGCTGGC TGGTCAGGCC
1021 TCTCAACTGA ATGCCGTGGT GGACTTGCAA GACAGAAACA CAGAGCTGTC CTACCAGCTC
1081 TTGCTTGACT CTCTGGGTGA CAGAACCAGG TATTTCAGTA TGTGGAATCA GGCGGTGGAC
1141 AGTTATGATC CTGATGTGCG CATTATTGAA AACCATGGTG TGGAGGATGA ATTGCCAAAC
1201 TATTGCTTCC CCTTGGATGG AGCAGGCACC AATTCGGTTT ACCAAGGTGT TAAACCAAAA
1261 ACTGACAATG GCAACGATCA GTGGGAAACA GATTCCACAG TTTCAAGTCA CAATCAGATA
1321 TGCAAAGGCA ATATCTATGC CATGGAGATC AACCTCCAGG CCAACCTGTG GAGAAGTTTT
1381 CTCTACTCGA ACGTGGCCCT GTACCTGCCC GATTCTTACA AGTACACGCC GGCCAACATC
1441 ACCCTGCCCA CCAACACCAA CACCTACGAT TACATGAACG GGAGAGTGGT GCCTCCCTCG
1501 CTGGTGGACG CCTACATCAA CATCGGGGCG CGCTGGTCGC TGGACCCCAT GGACAACGTG
1561 AATCCCTTCA ACCACCACCG CAACGCGGGC CTGCGCTACC GCTCCATGCT CCTGGGCAAC
1621 GGGCGCTACG TGCCCTTCCA CATCCAGGTG CCCCAGAAAT TTTTCGCCAT CAAGAGCCTC
1681 CTGCTCCTGC CCGGGTCCTA CACCTACGAG TGGAACTTCC GCAAGGACGT CAACATGATC
1741 CTGCAGAGCT CCCTCGGCAA CGACCTGCGC ACGGACGGGG CCTCCATCTC CTTCACCAGC
1801 ATCAACCTCT ACGCCACCTT CTTCCCCATG GCGCACAACA CGGCCTCCAC GCTCGAGGCC
1861 ATGCTGCGCA ACGACACCAA CGACCAGTCC TTCAACGACT ACCTCTCGGC GGCCAACATG
1921 CTCTACCCCA TCCCGGCCAA CGCCACCAAC GTGCCCATCT CCATCCCCTC GCGCAACTGG
1981 GCCGCCTTCC GCGGCTGGTC CTTCACGCGC CTCAAGACCC GCGAGACGCC CTCGCTGGGC
2041 TCCGGGTTCG ACCCCTACTT CGTCTACTCG GGCTCCATCC CCTACCTCGA CGGCACCTTC
2101 TACCTCAACC ACACCTTCAA GAAGGTCTCC ATCACCTTCG ACTCCTCCGT CAGCTGGCCC
2161 GGCAACGACC GCCTCCTGAC GCCCAACGAG TTCGAAATCA AGCGCACCGT CGACGGAGAG
2221 GGATACAACG TGGCCCAGTG CAACATGACC AAGGACTGGT TCCTGGTCCA GATGCTGGCC
2281 CACTACAACA TCGGCTACCA GGGCTTCTAC GTGCCCGAGG GCTACAAGGA CCGCATGTAC
2341 TCCTTCTTCC GCAACTTCCA GCCCATGAGC CGCCAGGTGG TGGACGAGGT CAACTACAAG
2401 GACTACCAGG CCGTCACCCT GGCCTACCAG CACAACAACT CGGGCTTCGT CGGCTACCTC
2461 GCGCCCACCA TGCGCCAGGG CCAGCCCTAC CCCGCCAACT ACCCGTACCC GCTCATCGGA
2521 AAGAGCGCCG TCACCAGCGT CACCCAGAAA AAGTTCCTCT GCGACAGGGT CATGTGGCGC
2581 ATCCCCTTCT CCAGCAACTT CATGTCCATG GGCGCGCTCA CCGACCTCGG CCAGAACATG
2641 CTCTATGCCA ACTCCGCCCA CGCGCTAGAC ATGAATTTCG AAGTCGACCC CATGGATGAG
2701 TCCACCCTTC TCTATGTTGT CTTCGAAGTC TTCGACGTCG TCCGAGTGCA CCAGCCCCAC
2761 CGCGGCGTCA TCGAGGCCGT CTACCTGCGC ACCCCCTTCT CGGCCGGTAA CGCCACCACC
2821 TAA  (SEQ ID NO: 17)
```

FIG. 22

```
   1  ATGGCCACCC CATCGATGCT GCCCCAGTGG GCGTACATGC ACATCGCCGG ACAGGACGCT
  61  TCGGAGTACC TGAGTCCGGG TCTGGTGCAG TTCGCCCGCG CCACAGACAC CTACTTCAGT
 121  CTGGGGAACA AGTTTAGGAA CCCCACGGTG GCGCCCACGC ACGATGTGAC CACCGACCGC
 181  AGCCAGCGGC TGACGCTGCG CTTCGTGCCC GTGGACGCG AGGACAACAC CTACTCGTAC
 241  AAAGTGCGCT ACACGCTGGC CGTGGGCGAC AACCGCGTGC TGGACATGGC CAGCACCTAC
 301  TTTGACATCC GCGGCGTGCT GGATCGGGGC CCTAGCTTCA AACCCTACTC CGGCACCGCC
 361  TACAACAGCC TGGCTCCCAA GGGAGCGCCC AATTCCAGCC AGTGGGAGCA AAAAAAGACT
 421  GGCAATAATG CCAATGGAGA TACGGAGAAT GTCACTTATG GTGTAGCTGC CATGGGAGGA
 481  ATTGACATCG ATAAAAATGG CCTTCAAATT GGAACCGATG ACACCAAAGA TGACGATAAT
 541  GAAATTTATG CAGACAAAAC ATATCAGCCT GAGCCGCAAA TAGGAGAGGA AAACTGGCAA
 601  GAAACATATT CCTACTATGG AGGTAGAGCT CTTAAAAAG ATACCAAAAT GAAGCCATGC
 661  TATGGCTCAT TTGCCAGACC TACCAATGTG AAAGGAGGAC AGGCAAAAAT AAAAACAGAT
 721  GGAGATGTTA AGTCATTTGA CATAGACCTA GCCTTCTTTG ATATTCCCAA TTCTGGCGCG
 781  GGAAATGGCA CAAATGTTAA CGATGATCCA GATATGGTTA TGTATACAGA AAATGTAAAT
 841  CTGGAAACCC CAGATACTCA TATTGTGTAC AAACCAGGAA CTTCAGATGA CAGCTCAAAG
 901  GTCAACTTGT GTCAGCAATC CATGCCTAAC AGACCCAATT ATATTGGCTT CAGAGACAAT
 961  TTTATTGGGC TTATGTACTA CAACAGCACT GGCAATATGG GTGTGCTGGC TGGTCAGGCC
1021  TCTCAACTGA ATGCCGTGGT GGACTTGCAA GACAGAAACA CAGAGCTGTC CTACCAGCTC
1081  TTGCTTGACT CTCTGGGTGA CAGAACCAGG TATTTCAGTA TGTGGAATCA GGCGGTGGAC
1141  AGTTATGATC CTGATGTGCG CATTATTGAA AACCATGGTG TGGAGGATGA ATTGCCAAAC
1201  TATTGCTTCC CCTTGGATGG AGCAGGCACC AATTCGGTTT ACCAAGGTGT TAAACCAAAA
1261  ACTGACAATG GCAACGATCA GTGGGAAACA GATTCCACAG TTTCAAGTCA CAATCAGATA
1321  TGCAAAGGCA ATATCTATGC CATGGAGATC AACCTCCAGG CCAACCTGTG GAGAAGTTTT
1381  CTCTACTCGA ACGTGGCCCT GTACCTGCCC GATTCTTACA AGTACACGCC GGCCAACATC
1441  ACCCTGCCCA CCAACACCAA CACCTACGAT TACATGAACG GGAGAGTGGT GCCTCCCTCG
1501  CTGGTGGACG CCTACATCAA CATCGGGGCG CGCTGGTCGC TGGACCCCAT GGACAACGTG
1561  AATCCCTTCA CCACCACCG CAACGCGGGC CTGCGCTACC GCTCCATGCT CCTGGGCAAC
1621  GGGCGCTACG TGCCCTTCCA CATCCAGGTG CCCCAGAAAT TTTTTGCCAT CAAGAGCCTC
1681  CTGCTCCTGC CCGGGTCCTA CACCTACGAG TGGAACTTCC GCAAGGACGT CAACATGATC
1741  CTGCAGAGCT CCCTCGGCAA CGACCTGCGC ACGGACGGGG CCTCCATCTC CTTCACCAGC
1801  ATCAACCTCT ACGCCACCTT CTTCCCCATG GCGCACAACA CGGCCTCCAC GCTCGAGGCC
1861  ATGCTGCGCA ACGACACCAA CGACCAGTCC TTCAACGACT ACCTCTCGGC GGCCAACATG
1921  CTCTACCCCA TCCCGGCCAA CGCCACCAAC GTGCCCATCT CCATCCCCTC GCGCAACTGG
1981  GCCGCCTTCC GCGGCTGGTC CTTCACGCGC CTCAAGACCC GCGAGACGCC CTCGCTGGGC
2041  TCCGGGTTCG ACCCCTACTT CGTCTACTCG GGCTCCATCC CCTACCTCGA CGGCACCTTC
2101  TACCTCAACC ACACCTTCAA GAAGGTCTCC ATCACCTTCG ACTCCTCCGT CAGCTGGCCC
2161  GGCAACGACC GCCTCCTGAC GCCCAACGAG TTCGAAATCA AGCGCACCGT CGACGGAGAG
2221  GGATACAACG TGGCCCAGTG CAACATGACC AAGGACTGGT TCCTGGTCCA GATGCTGGCC
2281  CACTACAACA TCGGCTACCA GGGCTTCTAC GTGCCCGAGG GCTACAAGGA CCGCATGTAC
2341  TCCTTCTTCC GCAACTTCCA GCCCATGAGC CGCCAGGTCG TGGACGAGGT CAACTACAAG
2401  GACTACCAGG CCGTCACCCT GGCCTACCAG CACAACAACT CGGGCTTCGT CGGCTACCTC
2461  GCGCCCACCA TGCGCCAGGG CCAGCCCTAC CCGCCAACCT ACCCCTACCC GCTCATCGGC
2521  AAGAGCGCCG TCGCCAGCGT CACCCAGAAA AGTTCCTCT GCGACCGGGT CATGTGGCGC
2581  ATCCCCTTCT CCAGCAACTT CATGTCCATG GGCGCGCTCA CCGACCTCGG CCAGAACATG
2641  CTCTACGCCA ACTCCGCCCA CGCGCTAGAC ATGAATTTCG AAGTCGACCC CATGGATGAG
2701  TCCACCCTTC TCTATGTTGT CTTCGAAGTC TTCGACGTCG TCCGAGTGCA CCAGCCCCAC
2761  CGCGGCGTCA TCGAGGCCGT CTACCTGCGC ACCCCCTTCT CGGCCGGTAA AGCCACCACC
2821  TAA (SEQ ID NO: 18)
```

FIG. 23

```
   1 ATGGCCACCC CATCGATGCT GCCCCAGTGG GCGTACATGC ACATCGCCGG ACAGGACGCT
  61 TCGGAGTACC TGAGTCCGGG TCTGGTGCAG TTCGCCCGCG CCACAGACAC CTACTTCAGT
 121 CTGGGGAACA AGTTTAGGAA CCCCACGGTG GCGCCCACGC ACGATGTGAC CACCGACCGC
 181 AGCCAGCGGC TGACGCTGCG CTTCGTGCCC GTGGACCGCG AGGACAACAC CTACTCGTAC
 241 AAAGTGCGCT ACACGCTGGC CGTGGGCGAC AACCGCGTGC TGGACATGGC CAGCACCTAC
 301 TTTGACATCC GCGGCGTGCT GGACCGGGGC CCTAGCTTCA ACCCTTACTC CGGCACCGCT
 361 TACAACAGCC TGGCCCCCAA GGGAGCACCC AATTCCAGCC AGTGGGAGCA AAAAAAGACT
 421 GGCAAAAATG CCAATGGAGA TACGGAGAAT GTCACTTATG GTGTAGCTGC CATGGGAGGA
 481 ATTGACATCG ATAAAAATGG CCTTCAAATT GGAACCGATG ACACCAAAGA TGGCGATAAT
 541 GAAATTTATG CAGACAAAAC ATATCAGCCT GAGCCGCAAA TAGGAGAGGA AAACTGGCAA
 601 GAAACATATT CCTACTATGG AGGTAGAGCT CTTAAAAAAG ATACCAAAAT GAAGCCATGC
 661 TATGGCTCAT TTGCTAGACC TACCAATGTG AAAGGAGGAC AGGCAAAAAT AAAAACAGAT
 721 GGAGATGTTA AGTCATTTGA CATAGACCTA GCCTTCTTTG ATATTCCAAA TTCTGGCGCG
 781 GGAAATGGCA CAAATGTTAA CGATGATCCA GATATGGTTA TGTATACAGA AAATGTAAAT
 841 CTGGAAACCC AGATACTCA TATTGTGTAC AAACCAGGAA CTTCAGATGA CAGCTCCGAG
 901 GTCAACTTGT GTCAGCAATC CATGCCTAAC AGACCCAATT ATATTGGCTT CAGAGACAAT
 961 TTTATTGGGC TTATGTACTA CAACAGCACT GGCAATATGG GTGTGCTGGC TGGTCAGGCC
1021 TCTCAACTGA ATGCCGTGGT GGACTTGCAA GACAGAAACA CAGAGCTGTC CTACCAGCTC
1081 TTGCTTGACT CTCTGGGTGA CAGAACCAGG TATTTCAGTA TGTGGAATCA GGCGGTGGAC
1141 AGTTATGATC CTGATGTGCG CATTATTGAA AACCATGGTG TGGAGGATGA ATTGCCAAAC
1201 TATTGCTTCC CCTTGGATGG AGCAGGCACC AATTCGGTTT ACCAAGGTGT AAACCAAAA
1261 ACTGACAATG GCAACGATCA GTGGGAAACA GATTCCACAG TTTCAAGTCA CAATCAGATA
1321 TGCAAAGGCA ATATCTATGC CATGGAGATC AATCTCCAGG CCAACCTGTG AGAAGTTTC
1381 CTCTACTCGA ACGTGGCCCT GTACCTGCCC GATTCTTACA GTACACGCC GGCCAACATC
1441 ACCCTGCCCA CCAACACCAA CACCTACGAT TACATGAACG GGAGAGTGGT GCCTCCCTCG
1501 CTGGTGGATG CCTACATCAA CATCGGAGCG CGCTGGTCGC TGGACCCCAT GGACAACGTC
1561 AATCCCTTCA ACCACCACCG CAATGCGGGG CTGCGCTACC GCTCCATGCT CCTGGGCAAC
1621 GGGCGCTACG TGCCCTTCCA CATCCAGGTG CCCCAGAAAT TTTTCGCCAT CAAGAGCCTT
1681 CTGCTCCTGC CCGGGTCCTA CACCTACGAG TGGAACTTCC GCAAGGACGT CAACATGATC
1741 CTGCAGAGCT CCCTCGGCAA CGACCTGCGC ACGGACGGGG CCTCCATCTC CTTCACCAGC
1801 ATCAACCTCT ACGCCACCTT CTTCCCCATG GCGCACAACA CGGCCTCCAC GCTCGAGGCC
1861 ATGCTGCGCA ACGACACCAA CGACCAGTCC TTCAACGACT ACCTCTCGGC GGCCAACATG
1921 CTCTACCCCA TCCCGGCCAA CGCCACCAAC GTGCCCATCT CCATCCCCTC GCGCAACTGG
1981 GCCGCCTTCC GCGGCTGGTC CTTCACGCGC CTCAAGACCA AGGAGACGCC CTCGCTGGGC
2041 TCCGGGTTCG ACCCATACTT CGTCTACTCG GGCTCCATCC CCTACCTCGA CGGCACCTTC
2101 TACCTCAACC ACACCTTCAA GAAGGTCTCC ATCACCTTCG ATTCCTCCGT CAGCTGGCCC
2161 GGCAACGACC GGCTCCTGAC GCCCAACGAG TTCGAAATCA AGCGCACCGT CGACGGCGAG
2221 GGATACAACG TGGCCCAGTG CAACATGACC AAGGACTGGT TCCTGGTCCA GATGCTGGCC
2281 CACTACAACA TCGGCTACCA GGGCTTCTAC GTGCCCGAGG GCTACAAGGA CCGCATGTAC
2341 TCCTTCTTCC GCAACTTCCA GCCCATGAGC CGCCAGGTGG TGGACGAGGT CAACTACAAG
2401 GACTACCAGG CCGTCACCCT GGCCTACCAG CACAACAACT CGGGCTTCGT CGGCTACCTC
2461 GCGCCCACCA TGCGCCAGGG CCAGCCCTAC CCCGCCAACT ACCCGTACCC GCTCATCGGC
2521 AAGAGCGCCG TCACCAGCGT CACCCAGAAA AAGTTCCTCT GCGACAGGGT CATGTGGCGC
2581 ATCCCCTTCT CCAGCAACTT CATGGTCCATG GGCGCGCTCA CCGACCTCGG GCAGAACATG
2641 CTCTATGCCA ACTCCGCCCA CGCGCTAGCA ATGAATTTCG AAGTCGACCC CATGGATGAG
2701 TCCACCCTTC TCTATGTTGT CTTCGAAGTC TTCGACGTCG TCCGAGTGCA CCAGCCCCAC
2761 CGCGGCGTCA TCGAGGCCGT CTACCTGCGC ACCCCCTTCT CGGCCGGTAA CGCCACCACC
2821 TAA  (SEQ ID NO: 19)
```

FIG. 24

```
   1 ATGGCCACCC CATCGATGCT GCCCCAGTGG GCGTACATGC ACATCGCCGG ACAGGACGCT
  61 TCGGAGTACC TGAGTCCGGG TCTGGTGCAG TTCGCCCGCG CCACAGACAC CTACTTCAGT
 121 CTGGGGAACA AGTTTAGGAA CCCCACGGTG GCACCCACGC ACGATGTGAC CACCGACCGC
 181 AGCCAGCGGC TGACGCTGCG CTTCGTGCCC GTGGACCGCG AGGACAACAC CTACTCGTAC
 241 AAAGTGCGCT ACACGCTGGC CGTGGGCGAC AACCGCGTGC TGGACATGGC CAGCACCTAC
 301 TTTGACATCC GCGGCGTGCT GGATCGGGGC CCTAGCTTCA ACCCTACTC CGGCACCGC T
 361 TACAACAGCC TGGCTCCCAA GGGAGCGCCC AACACTTGCC AGTGGACATA TACTGATAAC
 421 CAAACTGAGA AAACAGCCAC ATATGGAAAT GCACCCGTAG AGGGCATTAA CATTACAAAA
 481 GATGGCATTC AACTTGGAAC TGACAGCGAT GGTCAGGCAA TCTATGCAGA CGAAACTTAT
 541 CAGCCCGAAC CTCAGGTGGG AGATCCTGAA TGGCATGATA CCACAGGTAC AGAAGAAAAA
 601 TATGGAGGCA GAGCGCTTAA ACCTGCCACC GACATGAAAC CTTGCTATGG CTCTTTTGC C
 661 AAGCCAACTA ATGTTAAGGG AGGTCAGGCC AAAAGCAGAA CAAAAACTGA TGGAACAAC T
 721 GAGCCTGATA TTGACATGGC CTTTTTTGAT GGCAGAAATG CAACAACAGC TGGTTTGAC T
 781 CCAGAAATTG TTTTGTATAC TGAAAATGTG GATCTGGAAA CTCCAGATAC CCATATTGT A
 841 TACAAGGCAG GCACAGATGA CAGCAGCTCT TCTATCAATT GGGTCAGCA GTCCATGCC C
 901 AACAGACCCA ACTACATTGG CTTCAGAGAC AACTTTATCG GGCTCATGTA CTACAACAGC
 961 ACTGGCAATA TGGGTGTACT GGCTGGACAG GCCTCCAGC TGAATGCTGT GGTGGACTTG
1021 CAGGACAGAA ACACTGAACT GTCCTACCAG CTCTTGCTTG ACTCTCTGGG TGACAGAACC
1081 AGGTATTTCA GTATGTGGAA TCAGGCGGTG GACAGTTATG ACCCCGATGT GCGCATTATT
1141 GAAAATCACG GTGTGGAGGA TGAACTCCCC AACTATTGCT TCCCCCTGAA TGCTGTGGGT
1201 AGAACAAATA GTTATCAGGG AATTAAACCC AATGGAGGCG ATCCAGCTAC ATGGGCCAAA
1261 GATGAAAGCG TCAATGATTC TAATGAATTG GGCAAGGGCA ATCCTTTCGC CATGGAGATC
1321 AACATCCAGG CCAACCTGTG GCGGAACTTC CTCTACGCGA ACGTGGCGCT GTACCTGCCC
1381 GACTCCTACA AGTACACGCC GGCCAACATC ACGCTGCCCG CCAACACCAA CACCTACGAT
1441 TACATGAACG GCCGCGTGGT GGCGCCCTCG CTGGTGGACG CCTACATCAA CATCGGGGCG
1501 CGCTGGTCGC TGGACCCCAT GGACAACGTC AACCCCTTCA ACCACCACCG CAACGCGGGC
1561 CTGCGCTACC GCTCCATGCT CCTGGGCAAC GGGCGCTACG TGCCCTTCCA CATCCAGGTG
1621 CCCCAAAAGT TTTTCGCCAT CAAGAGCCTC CTGCTCCTGC CCGGGTCCTA CACCTACGAG
1681 TGGAACTTCC GCAAGGACGT CAACATGATC CTGCAGAGCT CCCTCGGCAA CGACCTGCGC
1741 ACGGACGGGG CCTCCATCGC CTTCACCAGC ATCAACCTCT ACGCCACCTT CTTCCCCATG
1801 GCGCACAACA CCGCCTCCAC GCTCGAGGCC ATGCTGCGCA ACGACACCAA CGACCAGTCC
1861 TTCAACGACT ACCTCTCGGC GGCCAACATG CTCTACCCCA TCCCGGCCAA CGCCACCAAC
1921 GTGCCCATCT CCATCCCCTC GCGCAACTGG GCCGCCTTCC GCGGATGGTC CTTCACGCGC
1981 CTCAAGACCC GCGAGACGCC CTCGCTAGGC TCCGGGTTCG ACCCCTACTT CGTCTACTCG
2041 GGCTCCATCC CCTACCTCGA CGGCACCTTC TACCTCAACC ACACCTTCAA GAAGGTCTCC
2101 ATCACCTTCG ACTCCTCCGT CAGCTGGCCC GGCAACGACC GCCTCCTGAC GCCCAACGAG
2161 TTCGAAATCA AGCGCACCGT CGACGGAGAG GGATACAACG TGGCCCAGTG CAACATGACC
2221 AAGGACTGGT TCCTGGTCCA GATGCTGGCC CACTACAACA TCGGCTACCA GGGCTTCTAC
2281 GTGCCCGAGG GCTACAAGGA CCGCATGTAC TCCTTCTTCC GCAACTTCCA GCCCATGAGC
2341 CGCCAGGTCG TGGACGAGGT CAACTACAAG GACTACCAGG CCGTCACCCT GGCCTACCAG
2401 CACAACAACT CGGGCTTCGT CGGCTACCTC GCGCCCACCA TGCGCAGGG CCAGCCCTAC
2461 CCCGCCAACT ACCCCTACCC GCTCATCGGC AAGAGCGCCG TCGCCAGCGT CACCCAGAAA
2521 AAGTTCCTCT GCGACCGGGT CATGTGGCGC ATCCCCTTCT CCAGCAACTT CATGTCCATG
2581 GGCGCGCTCA CCGACCTCGG CCAGAACATG CTCTACGCCA ACTCCGCCCA CGCGCTAGAC
2641 ATGAATTTCG AAGTCGACCC CATGGATGAG TCCACCCTTC TCTATGTTGT CTTCGAAGTC
2701 TTCGACGTCG TCCGAGTGCA CCAGCCCCAC CGCGGCGTCA TCGAGGCCGT CTACCTGCGC
2761 ACGCCCTTCT CGGCCGGCAA CGCCACCACC TAA   (SEQ ID NO: 20)
```

FIG. 25

```
   1 ATGGCCACCC CATCGATGCT GCCCCAGTGG GCGTACATGC ACATCGCCGG ACAGGACGCT
  61 TCGGAGTACC TGAGTCCGGG TCTGGTGCAG TTCGCCCGCG CCACAGACAC CTACTTCAGT
 121 CTGGGGAACA AGTTTAGGAA CCCCACGGTG GCGCCCACGC ACGATGTGAC CACCGACCGC
 181 AGCCAGCGGC TGACGCTGCG CTTCGTGCCC GTGGACCGCG AGGACAACAC CTACTCGTAC
 241 AAAGTGCGCT ACACGCTGGC CGTGGGCGAC AACCGCGTGC TGGACATGGC CAGCACCTAC
 301 TTTGACATCC GCGGCGTGCT GGATCGGGGC CCTAGCTTCA AACCCTACTC CGGCACCGCC
 361 TACAACAGCC TGGCTCCCAA GGGAGCGCCC AACACTTGCC AGTGGACATA TACTGATAAC
 421 CAAACTGAGA AAACAGCCAC ATATGGAAAT GCGCCTGTGC AAGGCATTAG TATTACAAAA
 481 GATGGTATTC AACTTGGAAC TGACACTGAT GATCAGCCCA TTTATGCAGA TAAAACTTAT
 541 CAACCAGAGC CTCAAGTGGG TGATGCTGAA TGGCATGACA TCACTGGTAC TGATGAAAAA
 601 TATGGAGGCA GAGCTCTCAA GCCTGACACC AAAATGAAGC CCTGCTATGG TTCTTTTGCC
 661 AAGCCTACCA ATAAAGAAGG AGGTCAGGCA AATGTGAAAA CCGAAACAGG CGGTACCAAA
 721 GAATATGACA TTGACATGGC ATTCTTCGAT AATCGAAGTG CAGCTGCGGC TGGCCTGGCC
 781 CCAGAAATTG TTTTGTATAC TGAGAATGTG GATCTGGAAA CTCCAGATAC TCATATTGTA
 841 TACAAGGCAG GCACAGATGA CAGCAGCTCT TCTATCAATT GGGTCAGCA GTCCATGCCC
 901 AACAGACCCA ACTACATTGG CTTCAGAGAC AACTTTATCG GTCTCATGTA CTACAACAGC
 961 ACTGGCAATA TGGGTGTACT GGCTGGTCAG GCCTCCCAGC TGAATGCTGT GGTGGACTTG
1021 CAGGACAGAA ACACTGAACT GTCCTACCAG CTCTTGCTTG ACTCTCTGGG TGACAGAACC
1081 AGGTATTTTA GTATGTGGAA TCAGGCGGTG GACAGTTATG ACCCCGATGT GCGCATTATT
1141 GAAAATCACG GTGTGGAGGA TGAACTCCCT AATTATTGCT TCCCCCTTAA TGCTGTGGGT
1201 AGAACTGATA CTTACCAGGG AATTAAGGCC AATGGTGCTG ATCAAACCAC ATGGACCAAA
1261 GATGATACTG TTAATGATGC TAATGAATTG GGCAAGGGCA ATCCTTTCGC CATGGAGATC
1321 AACATCCAGG CCAACCTGTG GCGGAACTTC CTCTACGCGA ACGTGGCCCT GTACCTGCCC
1381 GACTCCTACA AGTACACGCC GGCCAACATC ACGCTGCCCA CCAACACCAA CACCTACGAT
1441 TACATGAACG GCCGCGTGGT GGCGCCCTCG CTGGTGGACG CCTACATCAA CATCGGGGCG
1501 CGCTGGTCGC TGGACCCCAT GGACAACGTC AACCCCTTCA ACCACCACCG CAACGCGGGC
1561 CTGCGCTACC GCTCCATGCT CCTGGGCAAC GGGCGCTACG TGCCCTTCCA CATCCAGGTG
1621 CCCCAAAAGT TCTTCGCCAT CAAGAGCCTC CTGCTCCTGC CCGGGTCCTA CACCTACGAG
1681 TGGAACTTCC GCAAGGACGT CAACATGATC CTGCAGAGCT CCCTCGGCAA CGACCTGCGC
1741 ACGGACGGGG CCTCCATCGC CTTCACCAGC ATCAACCTCT ACGCCACCTT CTTCCCCATG
1801 GCGCACAACA CCGCCTCCAC GCTCGAGGCC ATGCTGCGCA ACGACACCAA CGACCAGTCC
1861 TTCAACGACT ACCTCTCGGC GGCCAACATG CTCTACCCCA TCCCGGCCAA TGCCACCAAC
1921 GTGCCCATCT CCATCCCCTC GCGCAACTGG GCCGCCTTCC GCGGATGGTC CTTCACGCGC
1981 CTCAAGACCC GCGAGACGCC CTCGCTAGGC TCCGGGTTCG ACCCCTACTT CGTCTACTCG
2041 GGCTCCATCC CCTACCTCGA CGGCACCTTC TACCTCAACC ACACCTTCAA GAAGGTCTCC
2101 ATCACCTTCG ACTCCTCCGT CAGCTGGCCC GGCAACGACC GCCTCCTGAC GCCCAACGAG
2161 TTCGAAATCA AGCGCACCGT CGACGAGAGG GGTACAACG TGCCCAGTG CAACATGACC
2221 AAGGACTGGT TCCTGGTCCA GATGCTGGCC CACTACAACA TCGGCTACCA GGGCTTCTAC
2281 GTGCCCGAGG GCTACAAGGA CCGCATGTAC TCCTTCTTCC GCAACTTCCA GCCCATGAGC
2341 CGCCAGGTCG TGGACGAGGT CAACTACAAG GACTACCAGG CCGTCACCCT GGCCTACCAG
2401 CACAACAACT CGGGCTTCGT CGGCTACCTC GCGCCCACCA TGCGCCAGGG CCAGCCCTAC
2461 CCCGCCAACT ACCCCTACCC GCTCATCGGC AAGAGCGCCG TCGCCAGCGT CACCCAGAAA
2521 AAGTTCCTCT GCGACCGGGT CATGTGGCGC ATCCCCTTCT CCAGCAACTT CATGTCCATG
2581 GGCGCGCTCA CCGACCTCGG CCAGAACATG CTCTACGCCA ACTCCGCCCA CGCGCTAGAC
2641 ATGAATTTCG AAGTCGACCC CATGGATGAG TCCACCCTTC TCTATGTTGT CTTCGAAGTC
2701 TTCGACGTCG TCCGAGTGCA CCAGCCCCAC CGCGGCGTCA TCGAGGCCGT CTACCTGCGC
2761 ACGCCCTTCT CGGCCGGCAA CGCCACCACC TAA   (SEQ ID NO: 21)
```

FIG. 26

```
   1 ATGGCGACCC CATCGATGAT GCCGCAGTGG TCGTACATGC ACATCTCGGG CCAGGACGCC
  61 TCGGAGTACC TGAGTCCCGG GCTGGTGCAG TTCGCTCGCG CCACCGAGAG CTACTTCAGT
 121 CTGAGTAACA AGTTTAGGAA CCCCACGGTG GCGCCCACGC ACGATGTGAC CACCGACCGG
 181 TCCCAGCGCC TGACGCTGCG GTTCATCCCC GTGGACCGCG AGGACACCGC GTACTCGTAC
 241 AAGGCGCGGT TCACCCTGGC CGTGGGCGAC AACCGCGTGC TGGACATGGC CTCCACCTAC
 301 TTTGACATCC GCGGCGTGCT GGACCGCGGC CCCACCTTCA AGCCCTACTC CGGCACCGCY
 361 TACAACTCCC TGGCCCCCAA GGGCGCTCCC AACTCCTGCG AGTGGGAGCA AGAGGAAACT
 421 CAGGCAGTTG AAGAAGCAGC AGAAGAGGAG GAAGAAGATG CTGACGGTCA AGCTGAGGAA
 481 GAGCAAGCAG CTACCAAAAA GACTCATGTA TATGCTCAGG CTCCCCTTTC CGGCGAAAAA
 541 ATTAGCAAAG ACGGTCTGCA GATAGGAACG ACGCTACAG CAACCGAACA AAAACCTATT
 601 TATGCAGACC CTACATTCCA GCCCGAACCC CAAATCGGGG AGTCCCAGTG GAATGAGGCA
 661 GATGCTACAG TCGCTGGTGG TAGAGTGCTC AAGAAAACCA CTCCCATGAA CCATGCTAT
 721 GGTTCCTATG CAAGACCCAC GAATGCTAAT GGAGGTCAGG GTGTACTAGC GGCAAATGCC
 781 CAAGGACAGC TAGAATCTCA GGTTGAAATG CAATTCTTTT CAACTTCTGA AAACGCCCGT
 841 AACGAGGCTA ACAACATTCA GCCCAAATTG GTGCTGTATA GCGAGGATGT GCACATGGAG
 901 ACCCCGGATA CACACCTCTC TTACAAGCCC ACAAAAAGCG ATGACAATTC TAAAGTTATG
 961 CTGGGCCAAC AGGCCATGCC CAACAGGCCT AATTACATTG CTTCAGAGA CAACTTTATC
1021 GGTCTCATGT ACTACAACAG CACTGGCAAC ATGGGAGTGC TTGCAGGTCA GGCCTCTCAG
1081 TTGAATGCAG TGGTGGACTT GCAAGACAGA AACACAGAAC TGTCCTACCA GCTCTTGCTT
1141 GATTCCATGG GTGACAGAAC CAGATATTTC TCCATGTGGA ATCAGGCAGT GGACAGTTAT
1201 GACCCAGATG TCAGAATTAT TGAAAATCAT GGAACTGAAG ACGAGCTCCC CAACTATTGT
1261 TTCCCTCTGG GCGGCATAGG GGTAACTGAC ACTTACCAGG CTGTTAAGAC CAACAATGGC
1321 AATAATGGGG GTCAGGTGAC TTGGACAAAA GATGAAACTT TTGCAGAGCG CAATGAGATA
1381 GGGGTGGGAA CAATTTCGC CATGGAGATC AACCTCAATG CCAACCTGTG GAGGAACTTC
1441 CTGTACTCCA ACGTGGCCCT GTACCTGCCA GACAAGCTTA AGTACAACCC CTCCAACGTG
1501 GACATCTCTG ACAACCCCAA CACCTACGAT TACATGAACA AGCGAGTGGT GGCCCCGGGG
1561 CTGGTGGACT GCTACATCAA CCTGGGCGCG CGCTGGTCGC TGGACTACAT GGACAACGTC
1621 AACCCTTTCA ACCACCACCG CAACGCGGGC CTGCGCTACC GCTCCATGCT CCTGGGCAAC
1681 GGGCGCTACG TGCCCTTCCA CATCCAGGTG CCCCAGAAGT TCTTTGCCAT CAAGAACCTC
1741 CTCCTCCTGC CGGGCTCCTA CACCTACGAG TGGAACTTCA GGAAGGATGT CAACATGGTC
1801 CTCCAGAGCT CTCTGGGCAA CGATCTCAGG GTGGACGGGG CCAGCATCAA GTTCGAGAGC
1861 ATCTGCCTCT ACGCCACCTT CTTCCCCATG GCCCACAACA CCGCCTCCAC GCTCGAGGCC
1921 ATGCTCAGGA ACGACACCAA CGACCAGTCC TTCAATGACT ACCTCTCCGC CGCCAACATG
1981 CTCTACCCCA TCCCCGCCAA CGCCACCAAC GTCCCCATCT CCATCCCCTC GCGCAACTGG
2041 GCGGCCTTCC GCGGCTGGGC CTTCACCCGC TCAAGACCA AGGAGACCCC CTCCCTGGGC
2101 TCGGGATTCG ACCCCTACTA CACCTACTCG GATCCATTC CCTACCTGGA CGGCACCTTC
2161 TACCTCAACC ACACTTTCAA GAAGGTCTCG GTCACCTTCG ACTCCTCGGT CAGCTGGCCG
2221 GCAACGACC GCCTGCTCAC CCCCAACGAG TTCGAGATCA AGCGCTCGGT CGACGGGGAG
2281 GGCTACAACG TGGCCCAGTG CAACATGACC AAGGACTGGT TCCTGGTCCA GATGCTGGCC
2341 AACTACAACA TCGGCTACCA GGGCTTCTAC ATCCCAGAGA GCTACAAGGA CAGGATGTAC
2401 TCCTTCTTCA GGAACTTCCA GCCCATGAGC CGGCAGGTGG TGGACCAGAC CAAGTACAAG
2461 GACTACCAGG AGGTGGGCAT CATCCACCAG CACAACAACT CGGGCTTCGT GGGCTACCTC
2521 GCCCCCACCA TGCGCGAGGG ACAGGCCTAC CCCGCCAACT TCCCCTACCC GCTCATAGGC
2581 AAGACCGCGG TCGACAGCAT CACCCAGAAA AAGTTCCTCT GCGACCGCAC CCTCTGGCGC
2641 ATCCCCTTCT CCAGCAACTT CATGTCCATG GGTGCGCTCA CGGACCTGGG CCAGAACCTG
2701 CTCTATGCCA ACTCCGCCCA CGCGCTCGAC ATGACCTTCG AGGTCGACCC CATGGACGAG
2761 CCCACCCTTC TCTATGTTCT GTTCGAAGTC TTTGACGTGG TCCGGGTCCA CCAGCCGCAC
2821 CGCGGCGTCA TCGAGACCGT GTACCTGCGC ACGCCCTTCT CGGCCGGCAA CGCCACCACC
2881 TAA   (SEQ ID NO: 22)
```

FIG. 27

```
   1 ATGGCCACCC CATCGATGCT GCCCCAGTGG GCGTACATGC ACATCGCCGG ACAGGACGCT
  61 TCGGAGTACC TGAGTCCGGG TCTGGTGCAG TTCGCCCGCG CCACAGACAC CTACTTCAGT
 121 CTGGGGAACA AGTTTAGGAA CCCCACGGTG GCGCCCACGC ACGATGTGAC CACCGACCGC
 181 AGCCAGCGGC TGACGCTGCG CTTCGTGCCC GTGGACCGCG AGGACAACAC CTACTCGTAC
 241 AAAGTGCGCT ACACGCTGGC CGTGGGCGAC AACCGCGTGC TGGACATGGC CAGCACCTAC
 301 TTTGACATCC GCGGCGTGCT GGACCGGGGC CCTAGCTTCA ACCCTACTC CGGCACCGCC
 361 TACAACAGCC TGGCCCCCAA GGGAGCTCCC AATTCCAGTC AGTGGGAGCA GACGGAGAAC
 421 GGGGGCGGAC AGGCTACGAC TAAAACACAC ACCTATGGAG TTGCCCCAAT GGGTGGAACT
 481 AATATTACAG TCGACGGACT ACAAATTGGA ACTGACGCTA CAGCTGATAC GGAAAAACCA
 541 ATTTATGCTG ATAAAACATT CCAACCTGAG CCTCAGATAG GAGAGGAAAA CTGGCAAGAA
 601 ACTGAAAGCT TTTATGGCGG TAGGGCTCTT AAGAAAGACA CAAACATGAA GCCTTGTTAT
 661 GGCTCATTTG CCAGACCTAC CAATGAAAAG GGAGGTCAAG CTAAACTTAA AGTTGGAGCT
 721 GATGGGCTGC CGACCAAAGA ATTTGACATA GACCTAGCAT TCTTTGATAC TCCTGGTGGC
 781 ACTGTGACCG GAGGTACAGA GGAGTATAAA GCAGATATTG TTATGTATAC CGAAAACACG
 841 TATCTGGAAA CTCCAGACAC ACATGTGGTG TATAAACCAG GCAAGGATAA CACAAGTTCT
 901 AAAATTAACC TGGTCCAGCA GTCTATGCCC AACAGGCCCA ACTACATTGG GTTTAGGGAC
 961 AACTTTATTG GGCTCATGTA TTACAACAGC ACTGGCAATA TGGGTGTGCT GGCCGGTCAG
1021 GCTTCTCAGT TGAATGCTGT GGTTGACTTG CAAGACAGAA ACACTGAACT GTCTTACCAG
1081 CTCTTGCTTG ACTCTTTGGG TGACAGAACC AGGTATTTCA GTATGTGGAA TCAGGCGGTG
1141 GACAGTTATG ATCCTGATGT GCGCATTATT GAAAACCATG GTGTGGAAGA TGAACTTCCC
1201 AACTATTGCT TCCCCCTGGA TGGGTCTGGC ACTAACGCCG CTTACCAAGG TGTGAAAGTA
1261 AAAAATGGTC AAGATGGTGA TGTTGAGAGC GAATGGGAAA AGATGATAC TGTCGCAGCT
1321 CGAAATCAAT TATGCAAGGG CAACATTTTT GCCATGGAGA TCAATCTCCA GGCCAACCTG
1381 TGGAGAAGTT TTCTCTACTC GAACGTGGCC CTGTACCTGC CCGATTCTTA CAAGTACACG
1441 CCGGCCAACA TCACCCTGCC CACCAACACC AACACCTACG ATTACATGAA CGGGAGAGTG
1501 GTGCCTCCCT CGCTGGTGGA CGCCTACATC AACATCGGGG CGCGCTGGTC GCTGGACCCC
1561 ATGGACAACG TCAATCCCTT CAACCACCAT CGCAACGCGG GCTGCGCTA CCGCTCCATG
1621 CTCCTGGGCA ACGGGCGCTA CGTGCCCTTC CACATCCAGG TGCCCCAGAA ATTTTTCGCC
1681 ATTAAGAGCC TCCTGCTCCT GCCCGGGTCC TACACCTACG AGTGGAACTT CCGCAAGGAC
1741 GTCAACATGA TCCTGCAGAG CTCCCTCGGC AACGACCTGC GCACGACGG GCCTCCATC
1801 TCCTTCACCA GCATCAACCT CTACGCCACC TTCTTCCCCA TGGCGCACAA CACCGCCTCC
1861 ACGCTCGAGG CCATGCTGCG CAACGACACC AACGACCAGT CCTTCAACGA CTACCTCTCG
1921 GCGGCCAACA TGCTCTACCC CATCCCGGCC AACGCCACCA ACGTGCCCAT CTCCATCCCC
1981 TCGCGCAACT GGGCCGCCTT CCGCGGCTGG TCCTTCACGC GCCTCAAGAC CAAGGAGACG
2041 CCCTCGCTGG GCTCCGGGTT CGACCCCTAC TTCGTCTACT CGGGCTCCAT CCCCTACCTC
2101 GACGGCACCT TCTACCTCAA CCACACCTTC AAGAAGGTCT CCATCACCTT CGACTCCTCC
2161 GTCAGCTGGC CCGGCAACGA CCGGCTCCTG ACGCCCAACG AGTTCGAAAT CAAGCGCACC
2221 GTCGACGGCG AGGGCTACAA CGTGGCCCAG TGCAACATGA CCAAGGACTG GTTCCTGGTC
2281 CAGATGCTGG CCCACTACAA CATCGGCTAC CAGGGCTTCT ACGTGCCCGA GGGCTACAAG
2341 GACCGCATGT ACTCCTTCTT CCGCAACTTC CAGCCCATGA GCGCCAGGT CGTGGACGAG
2401 GTCAACTACA AGGACTACCA GGCCGTCACC CTGGCCTACC AGCACAACAA CTCGGGCTTC
2461 GTCGGCTACC TCGCGCCCAC CATGCGCCAG GGCAGCCCT ACCCCGCCAA CTACCCCTAC
2521 CCGCTCATCG GCAAGAGCGC CGTCGCCAGC GTCACCCAGA AAAAGTTCCT CTGCGACCGG
2581 GTCATGTGGC GCATCCCCTT CTCCAGCAAC TTCATGTCCA TGGGCGCGCT CACCGACCTC
2641 GGCCAGAACA TGCTCTACGC CAACTCCGCC CACGCGCTAG ACATGAATTT CGAAGTCGAC
2701 CCCATGGATG AGTCCACCCT TCTCTATGTT GTCTTCGAAG TCTTCGACGT CGTCCGAGTG
2761 CACCAGCCCC ACCGCGGCGT CATCGAGGCC GTCTACCTGC GCACCCCCTT CTCGGCCGGT
2821 AACGCCACCA CCTAA (SEQ ID NO: 23)
```

FIG. 28

```
   1 ATGGCGACCC CATCGATGAT GCCGCAGTGG TCGTACATGC ACATCTCGGG CCAGGACGCC
  61 TCNGAGTACC TGAGCCCCGG GCTGGTGCAG TTCGCCCGCG CCACCGAGAG CTACTTCAGC
 121 CTGAGTAACA AGTTTAGGAA CCCCACGGTG GCGCCCACGC ACGATGTGAC CACCGACCGG
 181 TCTCAGCGCC TGACGCTGCG GTTCATTCCC GTGGACCGCG AGGACACCGC GTACTCGTAC
 241 AAGGCGCGGT TCACCCTGGC CGTGGGCGAC AACCGCGTGC TGGACATGGC CTCCACCTAC
 301 TTTGACATCC GCGGGGTGCT GGACCGGGGT CCCACTTTCA AGCCCTACTC TGGCACCGCC
 361 TACAACTCCC TGGCCCCCAA GGGCGCTCCC AACTCCTGCG AGTGGGAGCA AGAGGAAACT
 421 CAGGCAGTTG AAGAAGCAGC AGAAGAGGAA GAAGAAGATG CTGACGGTCA AGCTGAGGAA
 481 GAGCAAGCAG CTACCAAAAA GACTCATGTA TATGCTCAGG CTCCCCTTTC TGGCGAAAAA
 541 ATTAGTAAAG ATGGTCTGCA AATAGGAACG GACGCTACAG CTACAGAACA AAAACCTATT
 601 TATGCAGACC CTACATTCCA GCCCGAACCC CAAATCGGGG AGTCACAGTG AATGAGGCA
 661 GATGCTACAG TCGCCGGCGG TAGAGTGCTA AAGAAATCTA CTCCCATGAA ACCATGCTAT
 721 GGTTCCTATG CAAGACCCAC AAATGCTAAT GGAGGTCAGG GTGTACTAAC GGCAAATGCC
 781 CAGGGACAGC TAGAATCTCA GGTTGAAATG CAATTCTTTT CAACTTCTGA AAACGCCCGT
 841 AACGAGACTA ACAACATTCA GCCCAAATTG GTGCTGTATA GTGAGGATGT GCACATGGAG
 901 ACCCCGGATA CGCACCTTTC TTACAAGCCC GCAAAAGCG ATGACAATTC AAAAATCATG
 961 CTGGGTCAGC AGTCCATGCC CAACAGACCT AATTACATCG GCTTCAGAGA TAACTTTATC
1021 GGCCTCATGT ATTACAATAG CACTGGCAAC ATGGGAGTGC TTGCAGGTCA GGCCTCTCAG
1081 TTGAATGCAG TGGTGGACTT GCAAGACAGA AACACAGAAC TGTCCTACCA GCTCTTGCTT
1141 GATTCCATGG GTGACAGAAC CAGATACTTT TCCATGTGGA ATCAGGCAGT GGACAGTTAT
1201 GACCCAGATG TTAGAATTAT TGAAAATCAT GGAACTGAAG ACGAGCTCCC CAACTATTGT
1261 TTCCCTCTGG GTGGCATAGG GGTAACTGAC ACTTACCAGG CTGTTAAAAC CAACAATGGC
1321 AATAACGGGG GCCAGGTGAC TTGGACAAAA GATGAAACTT TTGCAGATCG CAATGAAATA
1381 GGGGTGGGAA ACAATTTCGC TATGGAGATA AACCTCAGTG CCAACCTGTG GAGAAACTTC
1441 CTGTACTCCA ACGTGGCGCT GTACCTACCA GACAAGCTTA AGTACAACCC CTCCAATGTG
1501 GACATCTCTG ACAACCCCAA CACCTACGAT TACATGAACA AGCGAGTGGT GGCCCCGGGG
1561 CTGGTGGACT GCTACATCAA CCTGGGCGCG CGCTGGTCGC TGGACTACAT GGACAACGTC
1621 AACCCCTTCA ACCACCACCG CAATGCGGGC CTGCGCTACC GCTCCATGCT CCTGGGCAAC
1681 GGGCGCTACG TGCCCTTCCA CATCCAGGTG CCCCAGAAGT TCTTTGCCAT CAAGAACCTC
1741 CTCCTCCTGC CGGGCTCCTA CACCTACGAG TGGAACTTCA GGAAGGATGT CAACATGGTC
1801 CTCCAGAGCT CTCTGGGTAA CGATCTCAGG GTGGACGGGG CCAGCATCAA GTTCGAGAGC
1861 ATCTGCCTCT ACGCCACCTT CTTCCCCATG GCCCACAACA CGGCCTCCAC GCTCGAGGCC
1921 ATGCTCAGGA ACGACACCAA CGACCAGTCC TTCAATGACT ACCTCTCCGC CGCCAACATG
1981 CTCTACCCCA TACCCGCCAA CGCCACCAAC GTCCCCATCT CCATCCCCTC GCGCAACTGG
2041 GCGGCCTTCC GCGGCTGGGC CTTCACCCGC TCAAGACCA AGGAGACCCC CTCCCTGGGC
2101 TCGGATTCG ACCCCTACTA CACCTACTCG GCTCCATTC CCTACCTGGA CGGCACCTTC
2161 TACCTCAACC ACACTTTCAA GAAGGTCTCG GTCACCTTCG ACTCCTCGGT CAGCTGGCCG
2221 GCAACGACC GTCTGCTCAC CCCCAACGAG TTCGAGATCA AGCGCTCGGT CGACGGGGAG
2281 GGCTACAACG TGGCCCAGTG CAACATGACC AAGGACTGGT TCCTGGTCCA GATGCTGGCC
2341 AACTACAACA TCGGCTACCA GGGCTTCTAC ATCCCAGAGA GCTACAAGGA CAGGATGTAC
2401 TCCTTCTTCA GGAACTTCCA GCCCATGAGC CGGCAGGTGG TGGACCAGAC CAAGTACAAG
2461 GACTACCAGG AGGTGGGCAT CATCCACCAG CACAACAACT CGGGCTTCGT GGGCTACCTC
2521 GCCCCCACCA TGCGCGAGGG ACAGGCCTAC CCCGCCAACT TCCCCTATCC GCTCATAGGC
2581 AAGACCGCGG TCGACAGCAT CACCCAGAAA AAGTTCCTCT GCGACCGCAC CCTCTGGCGC
2641 ATCCCCTTCT CCAGCAACTT CATGTCCATG GGTGCGCTCT CGGACCTGGG CCAGAACTTG
2701 CTCTACGCCA ACTCCGCCCA CGCCCTCGAC ATGACCTTCG AGGTCGACCC CATGGACGAG
2761 CCCACCCTTC TCTATGTTCT GTTCGAAGTC TTTGACGTGG TCCGGGTCCA CCAGCCGCAC
2821 CGCGGCGTCA TCGAGACCGT GTACCTGCGT ACGCCCTTCT CGGCCGGCAA CGCCACCACC
2881 TAA (SEQ ID NO: 24)
```

FIG. 29

```
   1 ATGGCGACCC CATCGATGAT GCCGCAGTGG TCGTACATGC ACATCTCGGG CCAGGACGCC
  61 TCGGAGTACC TGAGCCCCGG GCTGGTGCAG TTCGCCCGCG CCACCGAGAG CTACTTCAGT
 121 CTGAGTAACA AGTTTAGGAA CCCCACGGTG GCGCCCACGC ACGATGTGAC CACCGACCGG
 181 TCCCAGCGCC TGACGCTGCG GTTCATCCCC GTGGACCGCG AGGACACCGC GTACTCGTAC
 241 AAGGCGCGGT TCACCCTGGC CGTGGGCGAC AACCGCGTGC TGGACATGGC CTCCACCTAC
 301 TTTGACATCC GCGGCGTGCT GGACCGCGGC CCCACCTTCA AGCCCTACTC CGGCACCGCC
 361 TACAACTCCC TGGCCCCCAA GGGCGCTCCC AACTCTTGTG AGTGGGAGCA ATTAGAAGAA
 421 GCCCAGGCCG CTTTGGAAGA CGAAGAATTA GAAGATGAAG ACGAGGAACC ACAGGATGAG
 481 GCGCCTGTGA AAAAGACCCA TGTATACGCT CAGGCTCCCC TTTCTGGAGA AGAAATTACT
 541 AAAGACGGTT TGCAAATAGG GTCAGATAAC ACAGAAGCTC AGTCTAAGCC TATATATGCA
 601 GACCCTACAT TCCAGCCCGA ACCCCAAATC GGGGAGTCCC AGTGGAACGA GGCAGATGCT
 661 ACAGTCGCTG GTGGTAGAGT GCTCAAGAAA ACCACTCCCA TGAAACCATG CTATGGTTCC
 721 TATGCAAGAC CCACGAATGC TAATGGAGGT CAGGGTGTGC TGGTGGCTGA TGATAAGGGG
 781 GTCCTTCAAT CTAAAGTTGA ATTGCAATTT TTTTCAAATA CTACTACTCT TAATCAGCGG
 841 GAGGGTAATG ATACAAAACC AAAAGTAGTG CTGTATAGCG AGGATGTGCA CATGGAAACA
 901 CCAGACACCC ACATTTCTTA CAAGCCCACA AAAAGCGATG ACAATTCTAA AGTTATGCTG
 961 GGCCAACAGT CCATGCCCAA CAGGCCTAAT TACATCGGCT TCAGAGACAA CTTTATCGGT
1021 CTCATGTACT ACAACAGCAC TGGCAACATG GGAGTGCTTG CAGGTCAGGC CTCTCAGTTG
1081 AATGCAGTGG TGGACTTGCA AGACAGAAAC ACAGAACTGT CCTACCAGCT CTTGCTTGAT
1141 TCCATGGGTG ACAGAACCAG ATATTTCTCC ATGTGGAATC AGGCAGTGGA CAGTTATGAC
1201 CCGGATGTCA GAATTATTGA AAATCATGGA ACCAAGACG AGCTCCCCAA CTATTGTTTT
1261 CCTCTGGGTG CATAGGGGT AACTGACACT TACCAGGTCA TTAAAACTAA TGGCAATGGT
1321 CAAGCAGACC CAACCTGGGA AAAAGATACA GAGTTTGCAG ACCGCAATGA AATAGGGGTG
1381 GGAAACAATT CGCCATGGA GATCAACCTC AATGCCAACC TGTGGAGGAA CTTCCTGTAC
1441 TCCAACGTGG CCCTGTACCT GCCAGACAAG CTTAAGTACA CCCCTCCAA CGTGGACATC
1501 TCTGACAACC CCAACACCTA CGATTACATG AACAAGCGAG TGGTGGCCCC GGGGCTGGTG
1561 GACTGCTACA TCAACCTGGG CGCGCGCTGG TCGCTGGACT ACATGGACAA CGTCAACCCC
1621 TTCAACCACC ACCGCAACGC GGGCCTGCGC TACCGCTCCA TGCTCCTGGG CAACGGGCGC
1681 TACGTGCCCT TCCACATCCA GGTGCCCCAG AAGTTCTTTG CCATCAAGAA CCTCCTCCTC
1741 CTGCCGGGCT CCTACACCTA CGAGTGGAAC TTCAGGAAGG ATGTCAACAT GGTCCTCCAG
1801 AGCTCTTTGG CAACGATCT CAGGGTGGAC GGGGCCAGCA TCAAGTTCGA GAGCATCTGC
1861 CTCTACGCCA CCTTCTTCCC CATGGCCCAC AACACCGCCT CCACGCTCGA GGCCATGCTC
1921 AGGAACGACA CCAACGACCA GTCCTTCAAT GACTACCTCT CCGCCGCCAA CATGCTCTAC
1981 CCCATCCCCG CCAACGCCAC CAACGTCCCT ATCTCCATCC CCTCGCGCAA CTGGGCGGCC
2041 TTCCGCGGCT GGGCCTTCAC CCGCCTCAAG ACCAAGGAGA CACCCTCCCT GGGCTCGGGA
2101 TTCGACCCCT ACTACACCTA CTCGGGATCC ATTCCCTACC TGGACGGCAC CTTCTACCTC
2161 AACCACACTT TCAAGAAGGT CTCGGTCACC TTCGACTCCT CGGTCAGCTG GCCGGGCAAC
2221 GACCGCCTGC TCACCCCCAA CGAGTTCGAG ATCAAGCGCT CGGTCGACGG GGAGGGCTAC
2281 AACGTGGCCC AGTGCAACAT GACCAAGGAC TGGTTCCTGG TCCAGATGCT GGCCAACTAC
2341 AACATCGGCT ACCAGGGCTT CTACATCCCA GAGAGCTACA AGGACAGGAT GTACTCCTTC
2401 TTCAGGAACT TCCAGCCCAT GAGCCGGCAG GTGGTGGACC AAACCAAGTA CAAGGACTAC
2461 CAGGAGGTGG GCATCATCCA CCAGCACAAC AACTCGGGCT TCGTGGGCTA CCTCGCCCCC
2521 ACCATGCGCG AGGGACAGGC CTACCCGCCC AACTTCCCCT ACCCGCTCAT AGGCAAGACC
2581 GCGGTCGACA GCATCACCCA GAAAAAGTTC CTCTGCGACC GCACCCTCTG GCGCATCCCC
2641 TTCTCCAGCA ACTTCATGTC CATGGGTGCG CTCACGGACC TGGGCCAGAA CCTGCTCTAT
2701 GCCAACTCCG CCCACGCGCT CGACATGACC TTCGAGGTCG ACCCCATGGA CGAGCCCACC
2761 CTTCTCTATG TTCTGTTCGA AGTCTTTGAC GTGGTCCGGG TCCACCAGCC GCACCGCGGC
2821 GTCATCGAGA CCGTGTACCT GCGCACGCCC TTCTCGGCCG GCAACGCCAC CACCTAA
(SEQ ID NO: 25)
```

FIG. 30

```
                                                                                                      100
         1
C1       MATPSMLPQW AYMHIAGQDA SEYLSPGLVQ FARATDTYFN LGNKFRNPTV APTHDVTTDR SQRLMLRFVP VDREDNTYSY KVRYTLAVGD NRVLDMASTF
CV68     MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD3    MATPSMMPQW SYMHISGQDA SEYLSPGLVQ FARATESYFS LSNKFRNPTV APTHDVTTDR SQRLTLRFIP VDREDTAYSY KARFTLAVGD NRVLDMASTY
CHAD4    MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD5    MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD6    MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD7    MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD8    MATPSMLPQW AYMHIAGQDA SEYLSPGLVQ FARATDTYFS LGNKFRNPTV APTHDVTTDR SQRLMLRFVP VDREDNTYSY KVRYTLAVGD NRVLDMASTF
CHAD9    MATPSMLPQW AYMHIAGQDA SEYLSPGLVQ FARATDTYFN LGNKFRNPTV APTHDVTTDR SQRLTLRFVP VDREDNTYSY KVRYTLAVGD NRVLDMASTY
CHAD10   MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD11   MATPSMMPQW SYMHISGQDA SEYLSPGLVQ FARATESYFS LSNKFRNPTV APTHDVTTDR SQRLTLRFIP VDREDTAYSY KARFTLAVGD NRVLDMASTY
CHAD16   MATPSMMPQW AYMHIAGQDA SEYLSPGLVQ FARATESYFS LSNKFRNPTV APTHDVTTDR SQRLTLRFIP VDREDTAYSY KARFTLAVGD NRVLDMASTF
CHAD17   MATPSMMPQW SYMHISGQDA SEYLSPGLVQ FARATESYFS LSNKFRNPTV APTHDVTTDR SQRLTLRFIP VDREDTAYSY KARFTLAVGD NRVLDMASTY
CHAD19   MATPSMMPQW SYMHISGQDA SEYLSPGLVQ FARATDTYFS LSNKFRNPTV APTHDVTTDR SQRLMLRFVP VDREDTAYSY KVRYTLAVGD NRVLDMASTF
CHAD20   MATPSMMPQW SYMHISGQDA SEYLSPGLVQ FARATESYFS LSNKFRNPTV APTHDVTTDR SQRLMLRFVP VDREDTAYSY KVRYTLAVGD NRVLDMASTY
CHAD22   MATPSMLPQW AYMHIAGQDA SEYLSPGLVQ FARATDTYFN LGNKFRNPTV APTHDVTTDR SQRLMLRFVP VDREDNTYSY KVRYTLAVGD NRVLDMASTF
CHAD24   MATPSMMPQW SYMHISGQDA SEYLSPGLVQ FARATESYFS LGNKFRNPTV APTHDVTTDR SQRLTLRFIP VDREDTAYSY KARFTLAVGD NRVLDMASTY
CHAD26   MATPSMMPQW AYMHIAGQDA SEYLSPGLVQ FARATESYFS LSNKFRNPTV APTHDVTTDR SQRLMLRFVP VDREDTAYSY KVRYTLAVGD NRVLDMASTF
CHAD30   MATPSMLPQW AYMHIAGQDA SEYLSPGLVQ FARATDTYFS LGNKFRNPTV APTHDVTTDR SQRLMLRFVP VDREDNTYSY KVRYTLAVGD NRVLDMASTF
CHAD31   MATPSMMPQW SYMHISGQDA SEYLSPGLVQ FARATESYFS LSNKFRNPTV APTHDVTTDR SQRLTLRFIP VDREDTAYSY KARFTLAVGD NRVLDMASTY
CHAD37   MATPSMLPQW AYMHIAGQDA SEYLSPGLVQ FARATDTYFN LGNKFRNPTV APTHDVTTDR SQRLTLRFVP VDREDNTYSY KVRYTLAVGD NRVLDMASTY
CHAD38   MATPSMMPQW AYMHIAGQDA SEYLSPGLVQ FARATDTYFS LGNKFRNPTV APTHDVTTDR SQRLMLRFVP VDREDNTYSY KVRYTLAVGD NRVLDMASTF
CHAD44   MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD82   MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
CHAD63   MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
PAN5     MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
PAN6     MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
PAN7     MATPSMLPQW AYMHIAGQDA SEYLSPGLVQ FARATDTYFS LGNKFRNPTV APTHDVTTDR SQRLTLRFVP VDREDNTYSY KVRYTLAVGD NRVLDMASTY
```

FIG. 31A

```
        101                                                                                              200
    C1  FDIRGVLDRG PSFKPYSGSA YNSLAPKGAP NTSQWLDKGV TTTDNNTENG DE...EDEVA EEGEEEKQAT YTFGNAPVKA EA..EITKE. GLPIGLEVPS
   CV68 FDIRGVLDRG PSFKPYSGTA YNSLAPKGAP NTCQWTYKAD GE........ .......... ....TATEKT YTYGNAPVQG I...NITKD. GIQLGTDTDD
  CHAD3 FDIRGVLDRG PTFKPYSGTA YNSLAPKGAP NSCEWEQ.EE TQAVEEAAEE EE.EDADGQA EEEQAATKKT HVYAQAPLSG E...KISKD. GLQIGTDATA
  CHAD4 FDIRGVLDRG PSFKPYSGTA YNSLAPKGAP NSSQWEQKKT GNNA...... .......... ....NGDTEN VTYGVAAMGG I...DIDKN. GLQIGTDDTK
  CHAD5 FDIRGVLDRG PSFKPYSGTA YNSLAPKGAP NSSQWEQKKT GNNA...... .......... ....NGDTEN VTYGVAAMGG I...DIDKN. GLQIGTDDTK
  CHAD6 FDIRGVLDRG PSFKPYSGTA YNSLAPKGAP NTSQWITKDN .......... .......... ....GTDKT YSFGNAPVRG L...DITEE. GLQIGPDESG
  CHAD7 FDIRGVLDRG PSFKPYSGTA YNSLAPKGAP NSSQWEQKKT GKNA...... .......... ....NGDTEN VTYGVAAMGG I...DIDKN. GLQIGTDDTK
  CHAD8 FDIRGVLDRG PSFKPYSGTA YNSLAPKGAP NTCQWIAKGS PVQDDAEQAQ E......... .......... ....QKDVT YTFGNAPVKA ED..DITKD. GLEVGIQIIG
  CHAD9 FDIRGVLDRG PSFKPYSGTA YNSLAPKGAP NTCQWTYTDN .......... .......... ....QTEKT ATYGNAPVEG I...NITKD. GIQLGTDSDG
 CHAD10 FDIRGVLDRG PSFKPYSGTA YNSLAPKGAP NTCQWTYTDN .......... .......... ....QTEKT ATYGNAPVQG I...SITKD. GIQLGTDTDD
 CHAD11 FDIRGVLDRG PTFKPYSGTA YNSLAPKGAP NSCEWEQ.EE TQAVEEAAEE EE.EDADGQA EEEQAATKKT HVYAQAPLSG E...KISKD. GLQIGTDATA
 CHAD16 FDIRGVLDRG PSFKPYSGTA YNSLAPKGAP NSSQWEQTEN GGGQ...... .......... ....ATTKT HTYGVAPMGG T...NITVD. GLQIGTDATA
 CHAD17 FDIRGVLDRG PTFKPYSGTA YNSLAPKGAP NSCEWEQ.EE TQAVEEAAEE EE.EDADGQA EEEQAATKKT HVYAQAPLSG E...KISKD. GLQIGTDATA
 CHAD19 FDIRGVLDRG PTFKPYSGTA YNSLAPKGAP NSCEWEQLEE AQAALEDEEL ED....EDEE PQDEAPVKKT HVYAQAPLSG E...EITKD. GLQIGSDNTE
 CHAD20 FDIRGVLDRG PTFKPYSGTA YNSLAPKGAP NPCEWDEAAT ALDIDLNAED DE....ESDE AQGEADQQKT HVFGQAPYSG Q...NITKE. GIQIGIDAAS
 CHAD22 FDIRGVLDRG PSFKPYSGTA YNSLAPKGAP NTSQWIAEGV KKENGEADNE AAV......E EEEEEKNLTT YTFGNAPVKA EG.GDITKDK GLPIGSEITD
 CHAD24 FDIRGVLDRG PSFKPYSGTA YNSLAPKGAP NPCEWDEAAT ALDIDLNAEE DEE....GDE AQGEADQQKT HVFGQAPYSG Q...NITKE. GIQIGTDATS
 CHAD26 FDIRGVLDRG PSFKPYSGTA YNSLAPKGAP NSSQWEQKKT GNNNG..... .......... ....NGGTES VTFGVAAMGG E...NITKE. GLQIGSDETK
 CHAD30 FDIRGVLDRG PSFKPYSGTA YNSLAPKGAP NPSQWLEQST TEGE...... .......... ....DDPTNTT HTFGIASMKG E...NITKE. GLQIGKEVTT
 CHAD31 FDIRGVLDRG PTFKPYSGTA YNSLAPKGAP NSCEWEQLEE AQAAVEDEEL EDE....DEE PQDEAPVKKT HVYAQAPLSG E...EITKN. GLQIGSDNTE
 CHAD37 FDIRGVLDRG PSFKPYSGTA YNALAPKAAP NPSQWEETTT GTDGN..... .......... ....AATTTT YAFGNAPVQA EA..KITKD. GLPVGLEITE
 CHAD38 FDIRGVLDRG PSFKPYSGTA YNSLAPKGAP NSSQWEQTET N......... .......... .......VNKT HSFGLAAMKG D...NITSD. GLQIGTDATS
 CHAD44 FDIRGVLDRG PSFKPYSGTA YNSLAPKGAP NSSQWEQNEN NGQ....... .......... ....GQAKT HTYGVAAMGG E...AIDKN. GLQIGTDAAD
 CHAD63 FDIRGVLDRG PSFKPYSGTA YNSLAPKGAP NTSQWKDS.. .......... .......... ....DSKM HTFGVAAMPG L...DITKE. GLKIVTDASK
 CHAD82 FDIRGVLDRG PSFKPYSGTA YNSLAPKGAP NTCQWTYKAD G......... .......... ....DTGTEKT YTYGNAPVQG I...SITKD. GLPIGDSSS
   PAN5 FDIRGVLDRG PSFKPYSGTA YNSLAPKGAP NSSQWEQAKT G......... .......... ....NGGTMET HTYGVAPMGG E...NITKD. GLQIGTDVTA
   PAN6 FDIRGVLDRG PSFKPYSGTA YNSLAPKGAP NTCQWTYKAG D......... .......... ....TDTEKT YTYGNAPVQG I...SITKD. GIQLGTDSDG
   PAN7 FDIRGVLDRG PSFKPYSGTA YNSLAPKGAP NTCQWTYKAG D......... .......... ....TDTEKT YTYGNAPVQG I...SITKD. GIQLGTDSDG
```

|        | 201 |  |  |  |  |  |  |  | 300 |
|--------|-----|---|---|---|---|---|---|---|---|
| C1     | EGDPKPIYAD | KLYQPEPQVG | EESWTDTDGT | DEKYGGRALK | PETKMKPCYG | SFAKPTNVKG | GQAKVKKVEE | G........KV | EYDIDMNFFD LRSQK... |
| CV68   | ....QPIYAD | KTYQPEPQVG | DAEWHDITGT | DEKYGGRALK | PDTKMKPCYG | SFAKPTNKEG | GQANVKTGTG | T........TK | EYDIDMAFFD NRSAAA.. |
| CHAD3  | T.EQKPIYAD | PTFQPEPQIG | ESQWNQETY. | .TVAGGRVLK | KSTPMKPCYG | SYARPTNANG | GQGVLTANAQ | G........QL | ESQVEMQFFS TSENARN. |
| CHAD4  | D.DDNEIYAD | KTYQPEPQIG | EENWQETY.. | .SYYGGRALK | KDTKMKPCYG | SFARPTNVKG | GQAKIKTDGD | .........VK | SFDIDLAFFD IPNSGAGNG |
| CHAD5  | D.DDNEIYAD | KTYQPEPQIG | EENWQETY.. | .SYYGGRALK | KDTKMKPCYG | SFARPTNVKG | GQAKIKTDGD | .........VK | SFDIDLAFFD IPNSGAGNG |
| CHAD6  | G.ESKKIFAD | KTYQPEPQLG | DEEWHDTIGA | EDKYGGRALK | PATNMKPCYG | SFAKPTNAKG | GQAKSRTKDD | G........TT | EPDIDMAFFD DRSQQA.. |
| CHAD7  | D.GDNEIYAD | KTYQPEPQIG | EENWQETY.. | .SYYGGRALK | KDTKMKPCYG | SFAKPTNVKG | GQAKSRTKDD | .........VK | SFDIDLAFFD IPNSGAGNG |
| CHAD8  | DE.ENPIYAD | KTYQPEPQVG | DEQWHDTTGT | TEQYGGRALK | PATNMRPCYG | SFARPTNEKG | GQAKTRKVEK | TEGDKKTEVE | ELDIDMDFYD ARSKKQ.. |
| CHAD9  | ....QAIYAD | BTYQPEPQVG | DPEWHDTTGT | DEKYGGRALK | PAIDMKPCYG | SFARPTNEKG | GQAKSRTKTD | G........TT | EPDIDMAFFD GRNATT.. |
| CHAD10 | ....QPIYAD | KTYQPEPQVG | DAEWHDITGT | DEKYGGRALK | PDTKMKPCYG | SFAKPTNKEG | GQANVKTETG | G........TK | EYDIDMAFFD NRSAAA.. |
| CHAD11 | T.EQKPIYAD | PTFQPEPQIG | ESQWNEADA. | .TVAGGRVLK | KTTPMKPCYG | SYARPTNANG | GQGVLAANAQ | G........QL | ESQVEMQFFS TSENARN. |
| CHAD16 | D.TEKPIYAD | KTFQPEPQIG | EENWQETE.. | .SFYGGRALK | KDTNMKPCYG | SFARPTNEKG | GQAKLKVGAD | GL.......PTK | EFDIDLAFFD TPGGTVTGG. |
| CHAD17 | T.EQKPIYAD | PTFQPEPQIG | ESQWNEADA. | .TVAGGRVLK | KSTPMKPCYG | SYARPTNANG | GQGVLTANAQ | G........QL | ESQVEMQFFS TSENARN. |
| CHAD19 | A.QSKPIYAD | PTFQPEPQIG | ESQWNEADA. | .TVAGGRVLK | KTTPMKPCYG | SFARPTNVKG | GQGVLVADDK | G........VL | QSKVELQFFS NTTTLNQR. |
| CHAD20 | Q.AQTPVYAD | KTFQPEPQIG | ESQWNETEI. | .SYGAGRVLK | KTTLMKPCYG | SYARPTNENG | GQGILLEQDG | .........KK | ESQVEMQFFS TTQAAAG.. |
| CHAD22 | G.EAKPIYAD | KLYQPEPQVG | EETWTDTDGT | TEKYGGRALK | PETKMKPCYG | SFAKPTNVKG | GQAKQKTETQ | LQ.......NQQV | EYDIDMNFFD QASQKA.. |
| CHAD24 | Q.AQTPLYAD | KTFQPEPQIG | ESQWNETEI. | .SHGAGRVLK | KTTLMKPCYG | SYARPTNENG | GQGILLEQDG | K........K | ESQVEMQFFS TTQAAAG.. |
| CHAD26 | T.DNKEIYAD | KTYQPEPQIG | EENWQETF.. | .SFYGGRALK | KDTKMKPCYG | SFARPTNEKG | GQAKFKVQDG | V........QTT | EYDIDLAFFD IPSTGTGGNG |
| CHAD30 | T.GDKPIYAD | KTFQPEPQIG | BETWTDTDGT | NEKFGGRTLK | SATNMKPCYG | SFARPTNKQG | GQAKTRKVAA | VDGG.....EETE | EPDIDMVFYD DRGATEA.. |
| CHAD31 | A.QSKPIYAD | PTFQPEPQIG | ESQWNEADA. | .TVAGGRVLK | KSTPMKPCYG | SFARPTNSNG | GQGVLVADDK | G........VL | QSKVELQFFS NTTTLNQR. |
| CHAD37 | D.EQKSIYAD | KLYQPEPQIG | DEQWHDTTGT | NEQYGGRALK | PATNMKPCYG | SFARPTNKKG | GQAKTRKIEK | EENGVKTVTE | EADIDMDFYD LRSQRA.. |
| CHAD38 | G.EEKPIYAD | KLYQPEPQIG | EESWTDTDGT | NEKFGGRVLK | KDTSMKPCYG | SFAKPTNVKG | GQAKQKATEG | T........AV | EYDVDMNFFD GRDAAA.. |
| CHAD44 | Q..DKPIYAD | KTFQPEPQVG | BEDWIDKA.. | .DFYGGRALK | KDTKMKPCYG | SFARPTNVKG | GQATPRTKAD | G........TT | EPDIDMNFFD PTTINT.. |
| CHAD82 | ED.DNEIYAD | KTYQPEPQIG | EENWQDTKN. | ..FYGGRALK | DTTNMKPCYG | SFARPTNKEG | GQANVKTEEN | .........VQ | SFDIDLAFFD IPSTGTGGNG |
| CHAD63 | G.TDTIIYAD | KTFQPEPQVG | SDSWVDTNGA | EEKYGGRALK | PDTKMKPCYG | SFAKPTNKEG | GQANIKDSET | AS.......TTP | NYDIDLAFFD SKNIAAN.. |
| PAN5   | ....QPIYAD | KTYQPEPQVG | DAEWHDITGT | DEKYGGRALK | PDTKMKPCYG | SFAKPTNKEG | GQANVKTETG | G........TK | EYDIDMAFFD NRSAAA.. |
| PAN6   | N.QNKPIYAD | KTFQPEPQVG | EENWQETE.. | .NFYGGRALK | KDTNMKPCYG | SYARPTNEKG | GQAKLKVGDD | G........VPTK | EFDIDLAFFD TPGGTVN.. |
| PAN7   | ....QAIYAD | ETYQPEPQVG | DAEWHDITGT | DEKYGGRALK | PDTKMKPCYG | SFAKPTNKEG | GQANVKTETG | G........TK | EYDIDMAFFD NRSAAAA.. |

FIG. 31D

| | 301 | | | | | | | | | 400 |
|---|---|---|---|---|---|---|---|---|---|---|
| C1 | ..TGLKPKIV | MYAENVDLET | PDTHVVYKPG | ASDASSHANL | GQQSMPNRPN | YIGFRDNFIG | LMYYNSTGNM | GVLAGQASQL | NAVVDLQDRN | TELSYQLLLD |
| CV68 | ..AGLAPEIV | LYTENVDLET | PDTHIVYKAG | TDDSSSSINL | GQQAMPNRPN | YIGFRDNFIG | LMYYNSTGNM | GVLAGQASQL | NAVVDLQDRN | TELSYQLLLD |
| CHAD3 | EANNIQPKIV | LYSEDVHMET | PDTHLSYKPA | KSDDNSKIML | GQQSMPNRPN | YIGFRDNFIG | LMYYNSTGNM | GVLAGQASQL | NAVVDLQDRN | TELSYQLLLD |
| CHAD4 | TNVNDDPDMV | MYTENVNLET | PDTHIVYKPG | TSDDSSKVNL | CQQSMPNRPN | YIGFRDNFIG | LMYYNSTGNM | GVLAGQASQL | NAVVDLQDRN | TELSYQLLLD |
| CHAD5 | TNVNDDPDMV | MYTENVNLET | PDTHIIYKPG | TSDDSSKVNL | GQQSMPNRPN | YIGFRDNFIG | LMYYNSTGNM | GVLAGQASQL | NAVVDLQDRN | TELSYQLLLD |
| CHAD6 | ...SFSPEIV | LYTENVDLDT | PDTHISYKPG | TDETSSSFNL | CQQSMPNRPN | YIGFRDNFIG | LMYYNSTGNM | GVLAGQASQL | NAVVDLQDRN | TELSYQLLLD |
| CHAD7 | TNVNDDPDMV | MYTENVNLET | PDTHIVYKPG | TSDDSSEVNL | GQQSMPNRPN | YIGFRDNFIG | LMYYNSTGNM | GVLAGQASQL | NAVVDLQDRN | TELSYQLLLD |
| CHAD8 | ...GYDPQIV | LYSENVNLET | PDTHIVYKPG | TDETSSSTNL | CQQSMPNRPN | YIGFRDNFIG | LMYYNSTGNM | GVLAGQASQL | NAVVDLQDRN | TELSYQLLLD |
| CHAD9 | ..AGLTPEIV | LYTENVDLET | PDTHIVYKAG | TDDSSSSINL | GQQSMPNRPN | YIGFRDNFIG | LMYYNSTGNM | GVLAGQASQL | NAVVDLQDRN | TELSYQLLLD |
| CHAD10 | ..AGLAPEIV | LYTENVDLET | PDTHIVYKAG | TDDSSSSINL | GQQSMPNRPN | YIGFRDNFIG | LMYYNSTGNM | GVLAGQASQL | NAVVDLQDRN | TELSYQLLLD |
| CHAD11 | EANNIQPKLV | LYSEDVHMET | PDTHLSYKPT | KSDDNSKVML | GQQAMPNRPN | YIGFRDNFIG | LMYYNSTGNM | GVLAGQASQL | NAVVDLQDRN | TELSYQLLLD |
| CHAD16 | .TEEYKADIV | MYTENTYLET | PDTHVVYKPG | KDNTSSKINL | VQQSMPNRPN | YIGFRDNFIG | LMYYNSTGNM | GVLAGQASQL | NAVVDLQDRN | TELSYQLLLD |
| CHAD17 | ETNNIQPKLV | LYSEDVHMET | PDTHLSYKPA | KSDDNSKIML | GQQAMPNRPN | YIGFRDNFIG | LAYYNSTGNM | GVLAGQASQL | NAVVDLQDRN | TELSYQLLLD |
| CHAD19 | EGNDTKPKVV | LYSEDVHMET | PDTHISYKPT | KSDDNSKVML | GQQSMPNRPN | YIGFRDNFIG | LMYYNSTGNM | GVLAGQASQL | NAVVDLQDRN | TELSYQLLLD |
| CHAD20 | NSDNPTPKVV | LYSEDVNLET | PDTHISYMPT | NNETNSRELL | GQQSMPNRPN | YIGFRDNFIG | LMYYNSTGNM | GVLAGQASQL | NAVVDLQDRN | TELSYQLLLD |
| CHAD22 | ..NFSPKIV  | MYAENVDLET | PDTHVVYKPG | TSEESSHANL | GQQAMPNRPN | YIGFRDNFIG | LMYYNSTGNM | GVLAGQASQL | NAVVDLQDRN | TELSYQLLLD |
| CHAD24 | NSDNPTPKLV | LYSEDVNLET | PDTHISYMPT | NNETNSRELL | GQQAMPNRPN | YIGFRDNFIG | LMYYNSTGNM | GVLAGQASQL | NAVVDLQDRN | TELSYQLLLD |
| CHAD26 | TNVNDKPDMV | MYTENVNLET | PDTHIVYKPG | TSDDSSKANL | CQQAMPNRPN | YIGFRDNFVG | LMYYNSTGNM | GVLAGQASQL | NAVVDLQDRN | TELSYQLLLD |
| CHAD30 | ...MMAPEVV | LYAENVNLET | PDTHISYKPT | TSDINSHENL | GQQAMPNRPN | YIGFRDNFIG | LMYYNSTGNM | GVLAGQASQL | NAVVDLQDRN | TELSYQLLLD |
| CHAD31 | EGNDTKPKVV | LYSEDVHMET | PDTHISYKPT | KSDDNSKIML | GQQSMPNRPN | YIGFRDNFIG | LMYYNSTGNM | GVLAGQASQL | NAVVDLQDRN | TELSYQLLLD |
| CHAD37 | ...NFDPKIV | LYSENVDLET | PDTHISYKPG | TDETSSSVNL | GQQAMPNRPN | YIGFRDNFIG | LMFYNSTGNM | GVLAGQASQL | NAVVDLQDRN | TELSYQLLLD |
| CHAD38 | ...NFTPEVV | LYAENVDLET | PDTHIVYKPG | TSDVSSHVNL | GQQAMPNRPN | YIGFRDNFIG | LMYYNSTGNM | GVLAGQASQL | NAVVDLQDRN | TELSYQLLLD |
| CHAD44 | ......PDVV | LYAENVDLQT | PDTHIVYKPG | TSDDSSEVNL | AQQAMPNRPN | YIGFRDNFIG | LMYYNSTGNM | GVLAGQASQL | NAVVDLQDRN | TELSYQLLLD |
| CHAD82 | TNVNDKPDMV | MYTENVNLET | PDTHIVYKPG | TSDDSSEANL | CQQAMPNRPN | YIGFRDNFIG | LMYYNSTGNM | GVLAGQASQL | NAVVDLQDRN | TELSYQLLLD |
| CHAD63 | ....YDPDIV | MYTENVELQT | PDTHIVFKPG | TSDESSEANL | GQQAMPNRPN | YIGFRDNFIG | LMYYNSTGNM | GVLAGQASQL | NAVVDLQDRN | TELSYQLLLD |
| PAN5 | ...GLAPEIV | LYTENVDLET | PDTHIVYKAG | TDDSSSSINL | GQQSMPNRPN | YIGFRDNFIG | LMYYNSTGNM | GVLAGQASQL | NAVVDLQDRN | TELSYQLLLD |
| PAN6 | GQDEYKADIV | MYTENTYLET | PDTHIVYKPG | KDDASSEINL | VQQSMPNRPN | YIGFRDNFIG | LMYYNSTGNM | GVLAGQASQL | NAVVDLQDRN | TELSYQLLLD |
| PAN7 | ...GLAPEIV | LYTENVDLET | PDTHIVYKAG | TDDSSSSINL | GQQSMPNRPN | YIGFRDNFIG | LMYYNSTGNM | GVLAGQASQL | NAVVDLQDRN | TELSYQLLLD |

```
       401
    C1 SLGDRTRYFS MWNQAVDSYD PDVRIIENHG VEDELPNYCF PLDGVGPRTD SYKGIETNGD ......ENT TWKDL.DPNG ISELAKGNPF AMEINIQANL
   CV68 SLGDRTRYFS MWNQAVDSYD PDVRIIENHG VEDELPNYCF PLDAVG.RTD TYQGIKANGT ......DQTT WTKDD.SVND ANEIGKGNPF AMEINIQANL
  CHAD3 SMGDRTRYFS MWNQAVDSYD PDVRIIENHG TEDELPNYCF PLGGIG.VTD TYQAVKTNNG NNG...GQVT WTKDE.TFAD RNEIGVGNNF AMEINLSANL
  CHAD4 SLGDRTRYFS MWNQAVDSYD PDVRIIENHG VEDELPNYCF PLDGAG.TNS VYQGVKPKT. DNG....NDQ WETDS.TVSS HNQICKGNIY AMEINIQANL
  CHAD5 SLGDRTRYFS MWNQAVDSYD PDVRIIENHG VEDELPNYCF PLDGAG.TNS VYQGVKPKT. DNG....NDQ WETDS.TVSS HNQICKGNIY AMEINIQANL
  CHAD6 SLGDRTRYFS MWNQAVDSYD PDVRIIENHG VEDELPNYCF PLDGVG.FTD TFQGIKVKTT NNGT.ANATE WESDT.SVNN ANEIAKGNPF AMEINIQANL
  CHAD7 SLGDRTRYFS MWNQAVDSYD PDVRIIENHG VEDELPNYCF PLDGAG.TNS VYQGVKPKT. DNG....NDQ WETDS.TVSS HNQICKGNIY AMEINIQANL
  CHAD8 SLGDRTRYFS MWNQAVDSYD PDVRIIENHG VEDELPNYCF PLDGVGPITE TYQGIKPITA DN.....ANDQ WEKNT.EVNG ANEIGKGNNY AMEINIQANL
  CHAD9 SLGDRTRYFS MWNQAVDSYD PDVRIIENHG VEDELPNYCF PLNAVG.RTN SYQGIKPNGG ......DPAT WAKDE.SVND SNELGKGNPF AMEINIQANL
 CHAD10 SLGDRTRYFS MWNQAVDSYD PDVRIIENHG VEDELPNYCF PLNAVG.RTD TYQGIKANGA ......DQTT WTKDD.TVND ANELGKGNPF AMEINIQANL
 CHAD11 SMGDRTRYFS MWNQAVDSYD PDVRIIENHG TEDELPNYCF PLGGIG.VTD TYQAVKTNNG NNG...GQVT WTKDE.TFAE RNEIGVGNNF AMEINLNANL
 CHAD16 SLGDRTRYFS MWNQAVDSYD PDVRIIENHG VEDELPNYCF PLDGSG.TNA AYQGVKVKNG QDGD..VESE WEKDD.TVAA RNQLCKGNIF AMEINLQANL
 CHAD17 SMGDRTRYFS MWNQAVDSYD PDVRIIENHG TEDELPNYCF PLGGIG.VTD TYQAVKTNNG NNG...GQVT WTKDE.TFAD RNEIGVGNNF AMEINLQANL
 CHAD19 SLGDRTRYFS MWNQAVDSYD PDVRIIENHG TEDELPNYCF PLGGIG.VTD TYQVIKT.NG NGQ....ADPT WEKDT.EFAD RNEIGVGNNF AMEINLSANL
 CHAD20 SMGDRTRYFS MWNQAVDSYD PDVRIIENHG TEDELPNYCF PLGGVI.NTE TFTKVKPKAA Q......DAQ WEKDS.EFSD KNEIRVGNNF AMEINLNANL
 CHAD22 SLGDRTRYFS MWNQAVDSYD PDVRIIENHG VEDELPNYCF PLDGVGVPTT SYKIIEPNGE ......GAD WKEPD...ING TSEIGQGNLF AMEINLQANL
 CHAD24 SMGDRTRYFS MWNQAVDSYD PDVRIIENHG VEDELPNYCF PLGGII.NTE TFTKVKPKAG ......QDAQ WEKDS.EFSD KNEIRVGNNF AMEINLNANL
 CHAD26 SMGDRTRYFS MWNQAVDSYD PDVRIIENHG VEDELPNYCF PLDGAG.TNA VYQGVKAKDN GNA...ANGN WEQDT.GVSS INQICKGNIY AMEINLQANL
 CHAD30 SLGDRTRYFS MWNQAVDSYD PDVRIIENHG VEDELPNYCF PLDGIG.PGK TYQGIKEKQG D.....BANK WEQDK.TYAT SNEIAIGNNL AMEINLSANL
 CHAD31 SMGDRTRYFS MWNQAVDSYD PDVRIIENHG IEDELPNYCF PLGGIG.VTD TYQAIKTNGN GQ.....ENPT WEKDT.EFAD RNEIGVGNNF AMEINLQANL
 CHAD37 SLGDRTRYFS MWNQAVDSYD PDVRIIENHG TEDELPNYCF PLDGVGPITG TYQGVEPDGN ......NGN WKKNT.NING ANEIGKGNNY AMEINLQANL
 CHAD38 SLGDRTRYFS MWNQAVDSYD PDVRIIENHG IEDELPNYCF PIDAVG.ITR TYQGIKTQNG ......QTTT WEKDT.SVST ANEIGIGNNL AMEINIQANL
 CHAD44 SLGDRTRYFS MWNQAVDSYD PDVRIIENHG VEDELPNYCF PLDGVG.TNT AYQGVKVKTT N......GNDT WEKDE.TVYE FNQIGKGDIY AMEINIQANL
 CHAD63 SLGDRTRYFS MWNQAVDSYD PDVRIIENHG VEDELPNYCF PLDGAG.TNA VYRGVKAKDN ......GN WEQDT.GVSS INQICKGNIY AMEINIQANL
 CHAD82 SLGDRTRYFS MWNQAVDSYD PDVRIIENHG VEDELPNYCF PLNGVG.FTD TYQGIKVKTD TAATGTNGTQ ......DQTT WTKDD.TVND ANEIHSGNPF AMEINIQANL
  PAN5  SLGDRTRYFS MWNQAVDSYD PDVRIIENHG VEDELPNYCF PLDGSG.TNA AYGGVKVKDG QDG...DVESE WENDD.TVAA RNQLCKGNIF AMEINLQANL
  PAN6  SLGDRTRYFS MWNQAVDSYD PDVRIIENHG VEDELPNYCF PLNGVG.FTD TYQGIKANGA ......DQTT WTKDD.TVND ANELGKGNPF AMEINIQANL
  PAN7  SLGDRTRYFS MWNQAVDSYD PDVRIIENHG VEDELPNYCF PLDAVG.RTD TYQGIKANGD ......NQTT WTKDD.TVND ANELGKGNPF AMEINIQANL
```

FIG. 31E

```
       501                                                                                           600
   C1  WRSFLYSNVA LYLPDSYKYT PTNVTLPENK NTYDYMNGRV VPPSLVDTYV NIGARWSLDA MDNVNPFNHH RNAGLRYRSM LLGNGRYVPF HIQVPQKFFA
 CV68  WRNFLYANVA LYLPDSYKYT PANVTLPTNT NTYDYMNGRV VAPSLVDAYI NIGARWSLDP MDNVNPFNHH RNAGLRYRSM LLGNGRYVPF HIQVPQKFFA
CHAD3  WRNFLYSNVA LYLPDKLKYN PSNVDISDNP NTYDYMNKRV VAPGLVDCYI NLGARWSLDP MDNVNPFNHH RNAGLRYRSM LLGNGRYVPF HIQVPQKFFA
CHAD4  WRSFLYSNVA LYLPDSYKYT PANITLPTNT NTYDYMNGRV VPPSLVDAYI NIGARWSLDP MDNVNPFNHH RNAGLRYRSM LLGNGRYVPF HIQVPQKFFA
CHAD5  WRSFLYSNVA LYLPDSYKYT PANITLPTNT NTYDYMNGRV VAPSLVDAYI NIGARWSLDP MDNVNPFNHH RNAGLRYRSM LLGNGRYVPF HIQVPQKFFA
CHAD6  WRNFLYANVA LYLPDSYKYT PANITLPANT NTYDYMNGRV VPPSLVDAYI NIGARWSLDP MDNVNPFNHH RNAGLRYRSM LLGNGRYVPF HIQVPQKFFA
CHAD7  WRSFLYSNVA LYLPDGYKYT PANVTLPDNK NTYGYINGRV VSPSLVDSYI NIGARWSLDL MDNVNPFNHH RNAGLRYRSM LLGNGRYVPF HIQVPQKFFA
CHAD8  WRSFLYSNVA LYLPDSYKYT PANITLPANT NTYDYMNGRV VAPSLVDAYI NIGARWSLDP MDNVNPFNHH RNAGLRYRSM LLGNGRYVPF HIQVPQKFFA
CHAD9  WRNFLYANVA LYLPDSYKYT PANITLPTNT NTYDYMNGRV VAPGLVDCYI NIGARWSLDP MDNVNPFNHH RNAGLRYRSM LLGNGRYVPF HIQVPQKFFA
CHAD10 WRNFLYSNVA LYLPDKLKYN PSNVDISDNP NTYDYMNKRV VPPSLVDAYI NIGARWSLDP MDNVNPFNHH RNAGLRYRSM LLGNGRYVPF HIQVPQKFFA
CHAD11 WRNFLYSNVA LYLPDKLKYN PSNVDISDNP NTYDYMNGRV VAPGLVDCYI NLGARWSLDY MDNVNPFNHH RNAGLRYRSM LLGNGRYVPF HIQVPQKFFA
CHAD16 WRSFLYSNVA LYLPDSYKYT PANITLPTNT NTYDYMNGRV VPPSLVDAYI NIGARWSLDY MDNVNPFNHH RNAGLRYRSM LLGNGRYVPF HIQVPQKFFA
CHAD17 WRNFLYSNVA LYLPDKLKYN PSNVDISDNP NTYDYMNGRV VAPGLVDCYI NLGARWSLDY MDNVNPFNHH RNAGLRYRSM LLGNGRYVPF HIQVPQKFFA
CHAD19 WRSFLYSNVA LYLPDKLKYN PSNVDISDNP NTYDYMNGRV VAPSLVDAYI NIGARWSLDY MDNVNPFNHH RNAGLRYRSM LLGNGRYVPF HIQVPQKFFA
CHAD20 WRNFLYANVA LYLPDKLKYT PSNVQISNNP NSYDYMNGRV VAPGLVDCYI NLGARWSLDY MDNVNPFNHH RNAGLRYRSM LLGNGRYVPF HIQVPQKFFA
CHAD22 WRSFLYSNVA LYLPDKLKYT PANVTLPTNT NTYDYMNGRV VPPSLVDTYV NIGARWSLDA MDNVNPFNHH RNAGLRYRSM LLGNGRYVPF HIQVPQKFFA
CHAD24 WRNFLYANVA LYLPDKLKYT PSNVQISNNP NSYDYMNGRV VAPGLVDCYI NLGARWSLDY MDNVNPFNHH RNAGLRYRSM LLGNGRYVPF HIQVPQKFFA
CHAD26 WRSFLYSNVA LYLPDAYKYT PANITLPANT NTYEYMNGRV VAPSLVDSYI NIGARWSLDP MDNVNPFNHH RNAGLRYRSM LLGNGRYVPF HIQVPQKFFA
CHAD30 WRNFLYSNVA LYLPDKLKYN PSNVDISDNP NTYDYMNKRV VAPGLVDCYI NLGARWSLDY MDNVNPFNHH RNAGLRYRSM LLGNGRYVPF HIQVPQKFFA
CHAD31 WRSFLYSNVA LYLPDGYKYT PANVTLPENK NTYGYINGRV VSPSLYDSYI NIGARWSLDL MDNVNPFNHH RNAGLRYRSM LLGNGRYVPF HIQVPQKIFA
CHAD37 WRSFLYSNVA LYLPDSYKYT PANVTLPTNT NTYDYMNGRV VAPSLVDAYI NIGARWSLDP MDNVNPFNHH RNAGLRYRSM LLGNGRYVPF HIQVPQKFFA
CHAD38 WRNFLYANVA LYLPDSYKYT PANITLPTNT NTYDYMNGRV VPPSLVDAYI NIGARWSLDP MDNVNPFNHH RNAGLRYRSM LLGNGRYVPF HIQVPQKFFA
CHAD44 WRSFLYSNVA LYLPDSYKYT PANITLPTNT NTYDYMNGRV VAPSLVDAYI NIGARWSLDP MDNVNPFNHH RNAGLRYRSM LLGNGRFVPF HIQVPQKFFA
CHAD82 WRNFLYANVA LYLPDSYKYT PANITLPANT NTYDYMNGRV VAPSLVDAYI NIGARWSLDP MDNVNPFNHH RNAGLRYRSM LLGNGRYVPF HIQVPQKFFA
CHAD63 WRSFLYSNVA LYLPDSYKYT PANITLPTNT NTYDYMNGRV TPPSLVDAYL NIGARWSLDP MDNVNPFNHH RNAGLRYRSM LLGNGRYVPF HIQVPQKFFA
 PAN5  WRNFLYANVA LYLPDSYKYT PANITLPTNT NTYDYMNGRV VAPSLVDAYI NIGARWSLDP MDNVNPFNHH RNAGLRYRSM LLGNGRYVPF HIQVPQKFFA
 PAN6  WRSFLYSNVA LYLPDSYKYT PTNVTLPTNT NTYDYMNGRV VPPSLVDAYI NIGARWSLDP MDNVNPFNHH RNAGLRYRSM LLGNGRYVPF HIQVPQKFFA
 PAN7  WRNFLYANVA LYLPDSYKYT PANITLPTNT NTYDYMNGRV VAPSLVDAYI NIGARWSLDP MDNVNPFNHH RNAGLRYRSM LLGNGRYVPF HIQVPQKFFA
```

FIG. 31F

|       | 601                                                                                                      | 700 |
|-------|----------------------------------------------------------------------------------------------------------|-----|
| C1    | VKNLLLLLPGS YTYEWNFRKD VNMVLQSSLG NDLRVDGASI SFTSINLYAT FFPMAHNTAS TLEAMLRNDT NDQSFNDYLS AANMLYPIPA NATNVPISIP |
| CV68  | IKSLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD3 | IKNLLLLLPGS YTYEWNFRKD VNMVLQSSLG NDLRVDGASI KFESICLYAT FFPMAHNTAS TLEAMLRNDT NDQSFNDYLS AANMLYPIPA NATNVPISIP |
| CHAD4 | IKSLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD5 | IKSLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD6 | IKSLLLLLPGS YTYEWNFRKD VNMILQSSLG NDLRTDGASI AFTSINLYAT FFPMAHNTAS TLEAMLRNDT NDQSFNDYLS AANMLYPIPA NATNVPISIP |
| CHAD7 | IKSLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD8 | IKNLLLLLPGS YTYEWNFRKD VNMVLQSSLG NDLRTDGASI SFTSINLYAT FFPMAHNTAS TLEAMLRNDT NDQSFNDYLS AANMLYPIPA NATNIPISIP |
| CHAD9 | IKSLLLLLPGS YTYEWNFRKD VNMILQSSLG NDLRTDGASI AFTSINLYAT FFPMAHNTAS TLEAMLRNDT NDQSFNDYLS AANMLYPIPA NATNVPISIP |
| CHAD10| IKSLLLLLPGS YTYEWNFRKD VNMVLQSSLG NDLRVDGASI KFESICLYAT FFPMAHNTAS TLEAMLRNDT NDQSFNDYLS AANMLYPIPA NATNVPISIP |
| CHAD11| IKNLLLLLPGS YTYEWNFRKD VNMILQSSLG NDLRTDGASI AFTSINLYAT FFPMAHNTAS TLEAMLRNDT NDQSFNDYLS AANMLYPIPA NATNVPISIP |
| CHAD16| IKSLLLLLPGS YTYEWNFRKD VNMVLQSSLG NDLRVDGASI SFTSINLYAT FFPMAHNTAS TLEAMLRNDT NDQSFNDYLS AANMLYPIPA NATNVPISIP |
| CHAD17| IKNLLLLLPGS YTYEWNFRKD VNMILQSSLG NDLRTDGASI KFESICLYAT FFPMAHNTAS TLEAMLRNDT NDQSFNDYLS AANMLYPIPA NATNVPISIP |
| CHAD19| IKNLLLLLPGS YTYEWNFRKD VNMVLQSSLG NDLRVDGASI KFESICLYAT FFPMAHNTAS TLEAMLRNDT NDQSFNDYLS AANMLYPIPA NATNVPISIP |
| CHAD20| IKNLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD22| VKNLLLLLPGS YTYEWNFRKD VNMVLQSSLG NDLRVDGASI SFTSINLYAT FFPMAHNTAS TLEAMLRNDT NDQSFNDYLS AANMLYPIPA NATNIPISIP |
| CHAD24| IKNLLLLLPGS YTYEWNFRKD VNMVLQSSLG NDLRVDGASI KFESICLYAT FFPMAHNTAS TLEAMLRNDT NDQSFNDYLS AANMLYPIPA NATNVPISIP |
| CHAD26| IKNLLLLLPGS YTYEWNFRKD VNMVLQSSLG NDLRVDGASI SFTSINLYAT FFPMAHNTAS TLEAMLRNDT NDQSFNDYLS AANMLYPIPA NATNVPISIP |
| CHAD30| IKSLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD31| IKSLLLLLPGS YTYEWNFRKD VNMVLQSSLG NDLRVDGASI KFESICLYAT FFPMAHNTAS TLEAMLRNDT NDQSFNDYLS AANMLYPIPA NATNVPISIP |
| CHAD37| IKNLLLLLPGS YTYEWNFRKD VNMVLQSSLG NDLRVDGASI SFTSINLYAT FFPMAHNTAS TLEAMLRNDT NDQSFNDYLS AANMLYPIPA NATNIPISIP |
| CHAD38| VKNLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD44| IKSLLLLLPGS YTYEWNFRKD VNMVLQSSLG NDLRVDGASI KFESICLYAT FFPMAHNTAS TLEAMLRNDT NDQSFNDYLS AANMLYPIPA NATNVPISIP |
| CHAD63| IKSLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| CHAD82| IKSLLLLLPGS YTYEWNFRKD VNMILQSSLG NDLRTDGASI SFTSINLYAT FFPMAHNTAS TLEAMLRNDT NDQSFNDYLS AANMLYPIPA NATNVPISIP |
| PAN5  | IKSLLLLLPGS YTYEWNFRKD VNMILQSSLG NDLRTDGASI AFTSINLYAT FFPMAHNTAS TLEAMLRNDT NDQSFNDYLS AANMLYPIPA NATNVPISIP |
| PAN6  | IKSLLLLLPGS YTYEWNFRKD VNMILQSSLG NDLRTDGASI AFTSINLYAT FFPMAHNTAS TLEAMLRNDT NDQSFNDYLS AANMLYPIPA NATNVPISIP |
| PAN7  | IKSLLLLLPGS YTYEWNFRKD VNMILQSSLG NDLRTDGASI AFTSINLYAT FFPMAHNTAS TLEAMLRNDT NDQSFNDYLS AANMLYPIPA NATNVPISIP |

FIG. 31G

| | 701 | | | | | | | 800 |
|---|---|---|---|---|---|---|---|---|
| C1 | SRNWAAFRGW | SFTRLKTKET | PSLGSGFDPY | FVYSGSIPYL | DGTFYLNHTF | KKVSIMFDSS | VSWPGNDRLL | TPNEFEIKRT | VDGEGYNVAQ | CNMTKDWFLV |
| CV68 | SRNWAAFRGW | SFTRLKTKET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD3 | SRNWAAFRGW | AFTRLKTKET | PSLGSGFDPY | YTYSGSIPYL | DGTFYLNHTF | KKVSVTFDSS | VSWPGNDRLL | TPNEFEIKRS | VDGEGYNVAQ | CNMTKDWFLV |
| CHAD4 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD5 | SRNWAAFRGW | SFTRLKTRET | PSLGSGFDPY | FVYSGSIPYL | DGTFYLNHTF | KKVSITFDSS | VSWPGNDRLL | TPNEFEIKRS | VDGEGYNVAQ | CNMTKDWFLV |
| CHAD6 | SRNWAAFRGW | SFTRLKTKET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD7 | SRNWAAFRGW | SFTRLKTRET | PSLGSGFDPY | FVYSGSIPYL | DGTFYLNHTF | KKVSIMFDSS | VSWPGNDRLL | TPNEFEIKRS | VDGEGYNVAQ | CNMTKDWFLV |
| CHAD8 | SRNWAAFRGW | SFTRLKTRET | PSLGSGFDPY | FVYSGSIPYL | DGTFYLNHTF | KKVSITFDSS | VSWPGNDRLL | CPNEFEIKRT | VDGEGYNVAQ | CNMTKDWFLV |
| CHAD9 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD10 | SRNWAAFRGW | SFTRLKTKET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD11 | SRNWAAFRGW | AFTRLKTKET | PSLGSGFDPY | YTYSGSIPYL | DGTFYLNHTF | KKVSVTFDSS | VSWPGNDRLL | TPNEFEIKRS | VDGEGYNVAQ | CNMTKDWFLV |
| CHAD16 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD17 | SRNWAAFRGW | AFTRLKTKET | PSLGSGFDPY | YTYSGSIPYL | DGTFYLNHTF | KKVSVTFDSS | VSWPGNDRLL | TPNEFEIKRS | VDGEGYNVAQ | CNMTKDWFLV |
| CHAD19 | SRNWAAFRGW | AFTRLKTKET | PSLGSGFDPY | YTYSGSIPYL | DGTFYLNHTF | KKVSVTFDSS | VSWPGNDRLL | TPNEFEIKRS | VDGEGYNVAQ | CNMTKDWFLV |
| CHAD20 | SRNWAAFRGW | SFTRLKTKET | PSLGSGFDPY | FVYSGSIPYL | DGTFYLNHTF | KKVSIMFDSS | VSWPGNDRLL | TPNEFEIKRS | VDGEGYNVAQ | CNMTKDWFLV |
| CHAD22 | SRNWAAFRGW | AFTRLKTKET | PSLGSGFDPY | YTYSGSIPYL | DGTFYLNHTF | KKVSVTFDSS | VSWPGNDRLL | TPNEFEIKRS | VDGEGYNVAQ | CNMTKDWFLV |
| CHAD24 | SRNWAAFRGW | AFTRLKTKET | PSLGSGFDPY | YTYSGSIPYL | DGTFYLNHTF | KKVSVTFDSS | VSWPGNDRLL | TPNEFEIKRS | VDGEGYNVAQ | CNMTKDWFLV |
| CHAD26 | SRNWAAFRGW | SFTRLKTRET | PSLGSGFDPY | FVYSGSIPYL | DGTFYLNHTF | KKVSIMFDSS | VSWPGNDRLL | TPNEFEIKRS | VDGEGYNVAQ | CNMTKDWFLV |
| CHAD30 | SRNWAAFRGW | SFTRLKTKET | PSLGSGFDPY | FVYSGSIPYL | DGTFYLNHTF | KKVSVTFDSS | VSWPGNDRLL | TPNEFEIKRT | VDGEGYNVAQ | CNMTKDWFLV |
| CHAD31 | SRNWAAFRGW | AFTRLKTKET | PSLGSGFDPY | YTYSGSIPYL | DGTFYLNHTF | KKVSVTFDSS | VSWPGNDRLL | TPNEFEIKRS | VDGEGYNVAQ | CNMTKDWFLV |
| CHAD37 | SRNWAAFRGW | SFTRLKTKET | PSLGSGFDPY | FVYSGSIPYL | DGTFYLNHTF | KKVSIMFDSS | VSWPGNDRLL | TPNEFEIKRS | VDGEGYNVAQ | CNMTKDWFLV |
| CHAD38 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD44 | SRNWAAFRGW | SFTRLKTKET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD63 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| CHAD82 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| PAN5 | SRNWAAFRGW | SFTRLKTKET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| PAN6 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |
| PAN7 | SRNWAAFRGW | SFTRLKTRET | PSLGSGFDPY | FVYSGSIPYL | DGTFYLNHTF | KKVSITFDSS | VSWPGNDRLL | TPNEFEIKRT | VDGEGYNVAQ | CNMTKDWFLV |

| | 901 | | | | | | | | 984 |
|---|---|---|---|---|---|---|---|---|---|
| C1 | TMWRIPFSSN | FMSMGALTDL | GQNLLYANSA | HALDMTFEVD | PMDEPTLLYL | LFEVFDVVRV | HQPHRGVIEA | VYLRTPFSAG | NATT |
| CV68 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD3 | TLWRIPFSSN | FMSMGALSDL | GQNLLYANSA | HALDMTFEVD | PMDEPTLLYV | LFEVFDVVRV | HQPHRGVIET | VYLRTPFSAG | NATT |
| CHAD4 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD5 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD6 | VMWRIPFSSN | FMSMGALTDL | GQNLLYANSA | HALDMNFEVD | PMDESTLLYV | VFEVFDVVRV | HQPHRGVIEA | VYLRTPFSAG | KATT |
| CHAD7 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD8 | TMWRIPFSSN | FMSMGALTDL | GQNMLYANSA | HALDMTFEVD | PMDEPTLLYV | VFEVFDVVRV | HQPHRGVIEA | VYLRTPFSAG | NATT |
| CHAD9 | VMWRIPFSSN | FMSMGALTDL | GQNLLYANSA | HALDMTFEVD | PMDEPTLLYL | LFEVFDVVRV | HQPHRGVIEA | VYLRTPFSAG | NATT |
| CHAD10 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD11 | TLWRIPFSSN | FMSMGALTDL | GQNLLYANSA | HALDMTFEVD | PMDEPTLLYV | LFEVFDVVRV | HQPHRGVIET | VYLRTPFSAG | NATT |
| CHAD16 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD17 | TLWRIPFSSN | FMSMGALSDL | GQNLLYANSA | HALDMTFEVD | PMDEPTLLYV | LFEVFDVVRV | HQPHRGVIET | VYLRTPFSAG | NATT |
| CHAD19 | TLWRIPFSSN | FMSMGALTDL | GQNMLYANSA | HALDMTFEVD | PMDEPTLLYV | LFEVFDVVRV | HQPHRGVIEA | VYLRTPFSAG | NATT |
| CHAD20 | TLWRIPFSSN | FMSMGALSDL | GQNMLYANSA | HALDMNFEVD | PMDEPTLLYV | LFEVFDVVRV | HQPHRGVIET | VYLRTPFSAG | NATT |
| CHAD22 | TMWRIPFSSN | FMSMGALTDL | GQNMLYANSA | HALDMTFEVD | PMDEPTLLYL | LFEVFDVVRV | HQPHRGVIEA | VYLRTPFSAG | NATT |
| CHAD24 | TLWRIPFSSN | FMSMGALTDL | GQNMLYANSA | HALDMNFEVD | PMDESTLLYV | LFEVFDVVRV | HQPHRGVIEA | VYLRTPFSAG | NATT |
| CHAD26 | VMWRIPFSSN | FMSMGALTDL | GQNMLYANSA | HALDMNFEVD | PMDESTLLYV | LFEVFDVVRV | HQPHRGVIEA | VYLRTPFSAG | NATT |
| CHAD30 | TMWRIPFSSN | FMSMGALTDL | GQNMLYANSS | HALDMNFEVD | PMDEPTLLYL | LFEVFDVVRA | HQPHRGVIEA | VYLRTPFSAG | NATT |
| CHAD31 | TLWRIPFSSN | FMSMGALTDL | GQNMLYANSA | HALDMTFEVD | PMDEPTLLYL | LFEVFDVVRV | HQPHRGVIET | VYLRTPFSAG | NATT |
| CHAD37 | TMWRIPFSSN | FMSMGALTDL | GQNMLYANSA | HALDMTFEVD | PMDEPTLLYL | LFEVFDVVRV | HQPHRGVIEA | VYLRTPFSAG | NATT |
| CHAD38 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD44 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD82 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| CHAD63 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| PAN5 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| PAN6 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |
| PAN7 | VMWRIPFSSN | FMSMGALTDL | GQNMLYANSA | HALDMNFEVD | PMDESTLLYV | VFEVFDVVRV | HQPHRGVIEA | VYLRTPFSAG | NATT |

FIG. 31J

AATAAAAGATCTTTATTTTCATTAGATCTGTGTGTTGGTTTTTTGTGTG (SEQ ID NO: 26)

ATGGAATTCGTTTAAACCATCATCAATAATATACCTC (SEQ ID NO: 27)

CGCTGGCACTCAAGAGTGGCCTC (SEQ ID NO: 28)

ATGAAGCTTGTTTAAACCCATCATCAATAATATACCT (SEQ ID NO: 29)

ATCTAGACAGCGTCCATAGCTTACCG (SEQ ID NO: 30)

ATGCTACGTAGCGATCGCGTGAGTAGTGTTTGGGGGTGGGTGGG (SEQ ID NO: 31)

TAGGCGCGCCGCTTCTCCTCGTTCAGGCTGGCG (SEQ ID NO: 32)

GATCTAGTTAGTTTAAACGAATTCGGATCTGCGACGCG (SEQ ID NO: 33)

TTCGATCATGTTTAAACGAAATTAAGAATTCGGATCC (SEQ ID NO: 34)

TATTCTGCGATCGCTGAGGTGGGTGAGTGGGCG (SEQ ID NO: 35)

TAGGCGCGCCCTTAAACGGCATTTGTGGGAG (SEQ ID NO: 36)

CGTCTAGAAGACCCGAGTCTTACCAGT (SEQ ID NO: 37)

CGGGATCCGTTTAAACCATCATCAATAATATACCTTATT (SEQ ID NO: 38)

ATGGAATTCGTTTAAACCATCATCAATAATATACCTT (SEQ ID NO: 39)

ATGACGCGATCGCTGATATCCTATAATAATAAAACGCAGACTTTG (SEQ ID NO: 40)

TGTCCTACCARCTCTTGCTTGA (SEQ ID NO: 45)

GTGGAARGGCACGTAGCG (SEQ ID NO: 46)

FIG. 32

CHIMPANZEE ADENOVIRUS VACCINE CARRIERS

CROSS-REFERENCE TO RELATED APPLICATIONS

This application is a §371 National Stage Application of PCT/EP2005/000558, international filing date of Jan. 18, 2005, which claims the benefit of U.S. Provisional Application No. 60/538,799, filed Jan. 23, 2004, herein incorporated by reference.

FIELD OF THE INVENTION

The present invention relates to the field of recombinant vectors and more specifically to the production and use of recombinant replication-defective chimpanzee adenoviral vectors to elicit immune responses in mammalian hosts.

BACKGROUND OF THE INVENTION

The adenoviruses (Ads) comprise a large family of double-stranded DNA viruses found in amphibians, avians, and mammals which have a nonenveloped icosahedral capsid structure (Straus, Adenovirus infections in humans. In *The Adenoviruses*. 451-498, 1984; Hierholzer et al., *J. Infect. Dis.*, 158: 804-813, 1988; Schnurr and Dondero, *Intervirology.*, 36: 79-83, 1993; Jong et al., *J Clin Microbiol.*, 37:3940-3945: 1999). In contrast to retroviruses, adenoviruses can transduce numerous cell types of several mammalian species, including both dividing and nondividing cells, without integrating into the genome of the host cell.

Generally speaking, adenoviral DNA is typically very stable and remains episomal (e.g., extrachromosomal), unless transformation or tumorigenesis has occurred. In addition, adenoviral vectors can be propagated to high yields in well-defined production systems which are readily amenable to pharmaceutical scale production of clinical grade compositions. These characteristics and their well-characterized molecular genetics make recombinant adenoviral vectors good candidates for use as vaccine carriers. Typically, the production of recombinant adenoviral vectors relies on the use of a packaging cell line which is capable of complementing the functions of adenoviral gene products that have been either deleted or engineered to be nonfunctional.

Presently, two well-characterized human subgroup C adenovirus serotypes (i.e., hAd2 and hAd5) are widely used as the sources of the viral backbone for most of the adenoviral vectors that are used for gene therapy. Replication-defective human adenoviral vectors have also been tested as vaccine carriers for the delivery of a variety of immunogens derived from a variety of infectious agents (e.g., viruses, parasites, or bacterial pathogens) and tumor cells, including tumor-associated antigens (TAAs). Studies conducted in experimental animals (e.g., rodents, canines and nonhuman primates) indicate that recombinant replication-defective human adenoviral vectors carrying transgenes encoding immunogens derived from the E6 and E7 oncoproteins of human papillomavirus (HPV-16) (He, Z et al., (2001) *Virology*, 270:3583-3590, the rabies virus glycoprotein (Xiang, Z. et al (1996) Virolgy, 219:220-227), the circumsporozoite protein of *Plasmodium falciparum* Rodriguez, E. et al. (1997) *J. Immunol.* 158:1268-1274) as well as other heterologous antigens elicit both humoral and cell-mediated immune responses against the transgene product. Generally speaking, investigators have reported success using human adenoviral vectors as vaccine carriers in nonhuman experimental systems by either using an immunization protocols that utilizes high doses of recombinant adenoviral vectors that are predicted to elicit immune responses; or by using immunization protocols which employ the sequential administration of adenoviral vectors that are derived from different serotypes but which carry the same transgene product as boosting immunizations (Mastrangeli, et al., *Human Gene Therapy*, 7: 79-87 (1996).

However, it is predicted that vaccine carriers derived from ubiquitous human serotypes, such as types 2 and 5, will encounter preexisting humoral and cellular immunity in the human population. Thus, although replication-defective recombinant human adenoviruses have been successfully employed as vaccine carriers in experimental systems employing rodent, canine, and nonhuman primate hosts; human innate and adaptive immunity is expected to significantly limit the utility of these serotypes as vaccine carriers. This expectation is based on the fact that subgroup C, which includes type 2 and type 5, adenoviral infection is endemic in the human population. As a consequence, the majority of humans seroconvert within the first five years of life as the result of a natural infection. Thus, vectors derived from viruses that naturally infect and replicate in humans may not be optimal candidates for use as vaccine carriers.

Another problem associated with the use of human adenoviral-derived vectors is the risk that the production method used to propagate the recombinant viruses will give rise to vector stocks that are contaminated with replication competent adenovirus (RCA). This is caused by homologous recombination between overlapping sequences from the recombinant vector and the adenoviral genes that are present in the E1-complementing helper cell lines such as human 293 (Graham, F. L. et al, (1977) *J. Gen. Virol.* 36:59-72) cells. The presence of RCA in vector stocks prepared for use in clinical trials constitutes a safety risk because it can promote the mobilization and spread of the replication defective virus. Spread of the defective virus can aggravate the host immune response and cause other adverse immunopathological consequences (Fallux, F. J., et al. Human Gene Therapy 9: 1909-1917 (1998). Accordingly, the Food and Drug Administration (FDA) and other regulatory bodies have promulgated guidelines which establish limits on the levels of RCA that can be present in vector preparations intended for clinical use. The intent of imposing RCA limits is to ensure limited exposure of patients to replicating adenovirus in compositions that are used in clinical trials.

Thus, there continues to be a need for the development of adenoviral vaccine carriers that are suitable for use in mammalian hosts which are: easy to manipulate, amenable to pharmaceutical scale production and long term storage, capable of high-level replication in human complementation cell lines, highly immunogenic, devoid of neutralizing B cell epitopes that cross-react with the common serotypes of human adenoviruses, comply with the safety RCA standards promulgated by regulatory agencies, and which are amenable for use in prime/boost protocols that are suitable for use in humans.

SUMMARY OF THE INVENTION

The present invention relates to recombinant replication-defective adenovirus vectors derived from chimpanzee adenoviruses and methods for generating chimpanzee adenoviral vectors in human E1-expressing cell lines. The invention also provides methods for generating clinical grade vector stocks suitable for use in humans and means for using the disclosed vectors as vaccine carriers to elicit protective and/or therapeutic immune responses. The invention further provides methods for using the recombinant adenoviruses of the invention to prepare vaccine compositions designed to delivery, and direct the expression of, transgenes encoding immunogens. In one embodiment, the invention contemplates the use of the disclosed vectors as vaccine carriers for the administration of vaccines comprising transgenes encoding immunogens derived from an infectious agent. In a second embodiment, the invention contemplates the use of the disclosed vectors to prepare and administer cancer vaccines. In a particular embodiment, the invention contemplates the preparation and administration of a cancer vaccine comprising a transgene encoding a TAA.

In one aspect, the invention discloses the complete genomic sequence of five chimpanzee adenoviruses (ChAds), referred to herein as ChAd3 (SEQ ID NO: 1) (FIGS. 5A-5K), ChAd6 (SEQ ID NO: 2) (FIGS. 6A-6K, CV32 (SEQ ID NO: 3) (FIGS. 7A-7K), CV33 (SEQ ID NO: 4) (FIGS. 8A-8K), and CV23 (SEQ ID NO: 5) (FIGS. 9A-9J).

ChAd3 and ChAd6 represent novel adenoviruses isolated according to the methods disclosed herein. The genomes of the ChAd3 and ChAd6 are 37741 and 36648 base pairs in length, respectively. The ChAd3 hexon gene (SEQ ID NO: 41) comprises nucleotides (nt) 19086-21965 of SEQ ID NO: 1 (exclusive of stop codon) and the ChAd3 fiber gene (SEQ ID NO: 42) comprises nt 32805-34487 of SEQ ID NO: 1 (exclusive of stop codon). The ChAd6 hexon gene comprises nt 18266-21124 (SEQ ID NO: 43) of SEQ ID NO: 2 (exclusive of stop codon) and its fiber gene (SEQ ID NO: 44) comprises nt 32218-33552 of SEQ ID NO:2 (exclusive of stop codon). Based on sequence homology deduced from a multiple sequence alignment of full-length hexon peptides, ChAd3 has been classified into human subgroup C and ChAd6 has been classified into human subgroup E.

The genomes of the CV32, CV33 and CV23 adenoviruses are 36,606, 36,535, and 32,020 base pairs in length, respectively. CV32 (Pan 6) (ATCC N. VR-592), CV33 (Pan 7) (ATCC N. VR-593) and CV23 (Pan 5) (Esoterix Inc.,) have all been determined to be related to human Ad4 (hAd4) (subgroup E) (Wigand, R et al. *Intervirology* 1989, 30:1-9). However, based on hexon sequence alignment CV32 has subsequently characterized as being more closely analogous to human subgroup D members than to hAd4.

In a second aspect, the invention provides nucleotide sequences for the fiber and hexon genes of 21 additional chimpanzee adenoviruses (ChAd20, ChAd4, ChAd5, ChAd7, ChAd9, ChAd10, ChAd11, ChAd16, ChAd17, ChAd19, ChAd8, ChAd22, ChAd24, ChAd26, ChAd30, ChAd31, ChAd37, ChAd38, ChAd44, ChAd63 and ChAd82) isolated according to the methods disclosed herein.

The fiber gene nucleotide sequences for ChAd20, ChAd4, ChAd5, ChAd7, ChAd9, ChAd10, ChAd11, ChAd16, ChAd17, ChAd19, are set forth in FIGS. 10-19, respectively, and are referred to herein as SEQ ID NOS: 6-15: (SEQ ID NO: 6, ChAd20); (SEQ ID NO: 7, ChAd4); (SEQ ID NO: 8, ChAd5); (SEQ ID NO: 9, ChAd7); (SEQ ID NO: 10, ChAd9); (SEQ ID NO: 11, ChAd10); (SEQ ID NO: 12, ChAd11); (SEQ ID NO: 13, ChAd16) (SEQ ID NO: 14, ChAd17) and (SEQ ID NO: 15, ChAd19).

The fiber gene nucleotide sequences for ChAd8, ChAd22, ChAd24, ChAd26, ChAd30, ChAd31, ChAd37, ChAd38, ChAd44, ChAd63 and ChAd82 referred to herein as: (SEQ ID NO: 58, ChAd8), (SEQ ID NO: 60, ChAd22), (SEQ ID NO: 62, ChAd24), (SEQ ID NO: 64, ChAd26), (SEQ ID NO: 66, ChAd30), (SEQ ID NO: 68, ChAd31), (SEQ ID NO: 70, ChAd37), (SEQ ID NO: 72, ChAd38), (SEQ ID NO: 74, ChAd44), (SEQ ID NO: 76, ChAd63) and (SEQ ID NO: 78, ChAd82) and are set forth in the sequence listing.

The hexon gene nucleotide sequences for ChAd20, ChAd4, ChAd5, ChAd7, ChAd9, ChAd10, ChAd11, ChAd16, ChAd17, ChAd19, are set forth in FIGS. 21-30, respectively, and are referred to herein as SEQ ID NOS: 16-25: (SEQ ID NO: 16, ChAd20); (SEQ ID NO: 17, ChAd4); (SEQ ID NO: 18, ChAd5); (SEQ ID NO: 19, ChAd7); (SEQ ID NO: 20, ChAd9); (SEQ ID NO: 21, ChAd10); (SEQ ID NO: 22, ChAd11); (SEQ ID NO: 23, ChAd16); (SEQ ID NO: 24, ChAd17) and (SEQ ID NO: 25, ChAd19).

The hexon gene nucleotide sequences for ChAd8, ChAd22, ChAd24, ChAd26, ChAd30, ChAd31, ChAd37, ChAd38, ChAd44, ChAd63 and ChAd82 referred to herein as: (SEQ ID NO: 97, ChAd8), (SEQ ID NO: 99, ChAd22), (SEQ ID NO: 101, ChAd24), (SEQ ID NO: 103, ChAd26), (SEQ ID NO: 105, ChAd30), (SEQ ID NO: 107, ChAd31), (SEQ ID NO: 109, ChAd37), (SEQ ID NO: 111, ChAd38), (SEQ ID NO: 113, ChAd44), (SEQ ID NO: 115, ChAd63) and (SEQ ID NO: 117, ChAd82) and are set forth in the sequence listing.

In a third aspect, the invention provides amino acid sequences for the fiber and hexon proteins of 21 additional chimpanzee adenoviruses (ChAd20, ChAd4, ChAd5, ChAd7, ChAd9, ChAd10, ChAd11, ChAd16, ChAd17, ChAd19, ChAd8, ChAd22, ChAd24, ChAd26, ChAd30, ChAd31, ChAd37, ChAd38, ChAd44, ChAd63 and ChAd82) isolated according to the methods disclosed herein.

The fiber proteins which are disclosed and claimed here as are referred to as: (SEQ ID NO: 83, ChAd3), (SEQ ID NO: 84, ChAd6), (SEQ ID NO: 48, ChAd20), (SEQ ID NO: 49, ChAd4), (SEQ ID NO: 50, ChAd5), (SEQ ID NO: 51, ChAd7), (SEQ ID NO: 52, ChAd9), (SEQ ID NO: 53, ChAd10), (SEQ ID NO: 54, ChAd11), (SEQ ID NO: 55, ChAd16), (SEQ ID NO: 56, ChAd17), (SEQ ID NO: 57, ChAd19), (SEQ ID NO: 59, ChAd8), (SEQ ID NO: 61, ChAd22), (SEQ ID NO: 63, ChAd24), (SEQ ID NO: 65, ChAd26), (SEQ ID NO: 67, ChAd30), (SEQ ID NO: 69, ChAd31), (SEQ ID NO: 71, ChAd37), (SEQ ID NO: 73, ChAd38), (SEQ ID NO: 75, ChAd44), (SEQ ID NO: 77, ChAd63) and (SEQ ID NO: 79, ChAd82). FIGS. 20A-20G provides an alignment comparing the amino acid sequences of the fiber proteins disclosed and claimed herein with the amino acid sequences of the fiber proteins of: C1 (SEQ ID NO: 85), CV68 (SEQ ID NO: 86), Pan5 (alternatively referred to as CV23) (SEQ ID NO: 80), Pan6 (alternatively referred to as CV32) (SEQ ID NO: 81), and Pan7 (alternatively referred to as CV33) (SEQ ID NO: 82).

The hexon proteins which are disclosed and claimed here as are referred to as: (SEQ ID NO: 122, ChAd3), (SEQ ID NO: 123, ChAd6), (SEQ ID NO: 87, ChAd20), (SEQ ID NO: 88, ChAd4), (SEQ ID NO: 89, ChAd5), (SEQ ID NO: 90, ChAd7), (SEQ ID NO: 91, ChAd9), (SEQ ID NO: 92, ChAd10), (SEQ ID NO: 93, ChAd11), (SEQ ID NO: 94, ChAd16), (SEQ ID NO: 95, ChAd17), (SEQ ID NO: 96, ChAd19), (SEQ ID NO: 98, ChAd8), (SEQ ID NO: 100, ChAd22), (SEQ ID NO: 102, ChAd24), (SEQ ID NO: 104, ChAd26), (SEQ ID NO: 106, ChAd30), (SEQ ID NO: 108, ChAd31), (SEQ ID NO: 110, ChAd37), (SEQ ID NO: 112, ChAd38), (SEQ ID NO: 114, ChAd44), (SEQ ID NO: 116, ChAd63) and (SEQ ID NO: 118, ChAd82). FIGS. 31A-31J provide a comparison of the amino acid sequences of the hexon proteins disclosed and claimed herein with the amino acid sequences of the hexon proteins of: C1 (SEQ ID NO: 124), CV68 (SEQ ID NO: 125), Pan5 (alternatively referred to as CV23) (SEQ ID NO: 119), Pan6 (alternatively referred to as CV32) (SEQ ID NO: 120), and Pan7 (alternatively referred to as CV33) (SEQ ID NO: 121). A multiple sequence alignment of hexon proteins allows an artisan to perform a phylogenetic analysis of that is consistent with the proposed classification of human adenoviral serotypes (Rux, J. J., et al (2003) J. Virol. 77:9553-9566).

In an alternative aspect, the invention further provides 21 additional chimpanzee adenovirus isolates. Samples comprising ChAd20, ChAd4, ChAd5, ChAd7, ChAd9, ChAd10, ChAd11, ChAd16, ChAd17 and ChAd19 were deposited on Dec. 12, 2003 with the European Collection of Cell Cultures (ECACC, Porton Down, Salisbury, Wiltshire, SP4 0JG, United Kingdom) as an original deposit under the Budapest Treaty. The deposits were assigned accession numbers: 03121201 (ChAd4), 03121202 (ChAd5), 03121203 (ChAd7), 03121204 (ChAd9), 03121205 (ChAd10), 03121206 (ChAd11), 03121207 (ChAd16), 03121208 (ChAd17), 03121209 (ChAd19) and 03121210 (ChAd20).

Samples comprising ChAd8, ChAd22, ChAd24, ChAd26, ChAd30, ChAd31, ChAd37, ChAd38, ChAd44, ChAd63 and ChAd82 were deposited with the ECACC (Porton Down, Salisbury, Wiltshire, SP4 0JG, United Kingdom) as an original deposit under the Budapest Treaty on Jan. 12, 2005. These deposits were assigned accession numbers: 05011201 (ChAd8), 05011202 (ChAd22), 05011203 (ChAd24), 05011204 (ChAd26), 05011205 (ChAd30), 05011206 (ChAd31), 05011207 (ChAd37), 05011208 (ChAd38), 05011209 (ChAd44), 05011210 (ChAd63) and 05011211 (ChAd82).

These deposits will be maintained under the terms of the Budapest Treaty on the International Recognition of the Deposit of Microorganisms for the Purposes of Patent Procedure. These deposits were made merely as a convenience for those of skill in the art and are not an admission that a deposit is required under 35 U.S.C. §112. All restrictions on the availability to the public of the deposited material will be irrevocably removed, except for the requirements specified in 37 C.F.R. §1.808(b), upon the granting of a patent.

In an additional aspect, the invention also provides replication-defective recombinant adenoviral vectors which are capable of infecting mammalian cells, preferably human cells, and directing expression of encoded transgene product(s). As demonstrated herein, the disclosed vectors are suitable for use as vaccine carriers for the delivery of transgenes comprising immunogens against which an immune response is desired. In particular embodiments, the invention provides recombinant replication-defective chimpanzee adenoviral vectors that are capable of high-level replication in human E1-expressing (i.e., packaging) cell lines. In one embodiment, the invention provides recombinant adenoviruses that are capable of replicating in PER.C6™ cells.

Generally speaking, the recombinant vectors encompassed by the invention provide vaccine carriers that will evade pre-existing immunity to the adenovirus serotypes that are typically encountered in the human population. More specifically, the recombinant vectors of the invention comprise vector backbone sequences which are shown herein to be devoid of neutralizing B epitopes that cross-react with the common serotypes of human adenoviral derived vectors.

The invention further provides group-specific shuttle vectors that include an adenoviral portion and a plasmid portion, wherein said adenoviral portion generally comprises: a) viral left end (ITR and packaging signal), part of the pIX gene and viral genome right end; and b) a gene expression cassette. The group-specific shuttle vectors are designed to exploit the nucleotide sequence homology which is observed between adenoviruses that are assigned to the same serotype subgroup (i.e., subgroups A, B, C, D or E), and can be used to manipulate the nucleotide sequences disclosed herein and/or to clone other chimpanzee adenoviruses belonging to the same subgroup generating an adenovirus pre-plasmid containing a chimp adenoviral genome deleted of E1 region.

Other aspects of this invention include host cells comprising the adenoviral vaccine vectors and/or the adenovirus pre-plasmid vectors, methods of producing the vectors comprising introducing the adenoviral vaccine vector into a host cell which expresses adenoviral E1 protein, and harvesting the resultant adenoviral vaccine vectors. In a particular embodiment, the invention provides a method of producing a replication-defective chimpanzee adenoviral vector comprising introducing one of the disclosed adenoviral vectors into an adenoviral E-1 expressing human cell, and harvesting the resulting recombinant adenoviruses.

Another aspect of the invention also provides vaccine compositions which comprise an adenoviral vector of the invention. Compositions comprising recombinant chimpanzee adenoviral vectors may be administered alone or in combination with other viral- or non-viral-based DNA/protein vaccines. They also may be administered as part of a broader treatment regimen. These compositions can be administered to mammalian hosts, preferably human hosts, in either a prophylactic or therapeutic setting. As shown herein, administration of the disclosed vaccine compositions, either alone or in a combined modality, such as a prime boost regimen or multiple injections of serologically distinct Ad vectors results in the induction of an immune response in a mammal that is capable of specifically recognizing the immunogen encoded by the transgene.

One of the methods disclosed and claimed herein, comprises administering to a mammal (that is either naïve or primed to be immunoreactive to a target antigen), a sufficient amount of a recombinant chimpanzee adenoviral vector, containing at least a functional deletion of its wild-type E1 gene, carrying a sequence comprising a promoter capable of directing expression of a nucleotide sequence encoding the least one target antigen, wherein administration of the recombinant vector elicits (or primes) an antigen-specific immune response.

In one embodiment, the invention provides a method designed to induce an immune response (prophylactic or therapeutic) against an infectious agent (e.g., a viral or bacterial pathogen or a mammalian parasite). In a second embodiment, the invention provides a method designed to induce an immune response in a mammal that will break tolerance to a self-antigen, such as a TAA. This aspect of the invention contemplates the use of the disclosed vectors as a vaccine carrier for the preparation and administration of cancer vaccines.

Yet other embodiments and advantages of the present invention will be readily apparent from the following detailed description of the invention.

BRIEF DESCRIPTION OF THE DRAWINGS

FIGS. 5A-5K provides the genomic nucleotide sequence of ChAd3 (SEQ ID NO: 1).

FIGS. 6A-6K provides the genomic nucleotide sequence of ChAd6 (SEQ ID NO: 2).

FIGS. 7A-7K provides the genomic nucleotides sequence of CV32 (SEQ ID NO: 3).

FIGS. 8A-8K provides the genomic nucleotide sequence of CV33 (SEQ ID NO: 4).

FIGS. 9A-9J provides the genomic nucleotide sequence of CV23 (SEQ ID NO: 5).

FIG. 10 provides the nucleotide sequence of the fiber gene of ChAd20 (SEQ ID NO: 6).

FIG. 11 provides the nucleotide sequence of the fiber gene of ChAd4 (SEQ ID NO: 7).

FIG. 12 provides the nucleotide sequence of the fiber gene of ChAd5 (SEQ ID NO: 8).

FIG. 13 provides the nucleotide sequence of the fiber gene of ChAd7 (SEQ ID NO: 9).

FIG. 14 provides the nucleotide sequence of the fiber gene of ChAd9 (SEQ ID NO: 10).

FIG. 15 provides the nucleotide sequence of the fiber gene of ChAd10 (SEQ ID NO: 11).

FIG. 16 provides the nucleotide sequence of the fiber gene of ChAd11 (SEQ ID NO: 12).

FIG. 17 provides the nucleotide sequence of the fiber gene of ChAd16 (SEQ ID NO: 13).

FIG. 18 provides the nucleotide sequence of the fiber gene of ChAd17 (SEQ ID NO: 14).

FIG. 19 provides the nucleotide sequence of the fiber gene of ChAd19 (SEQ ID NO: 15).

Figure 20A:
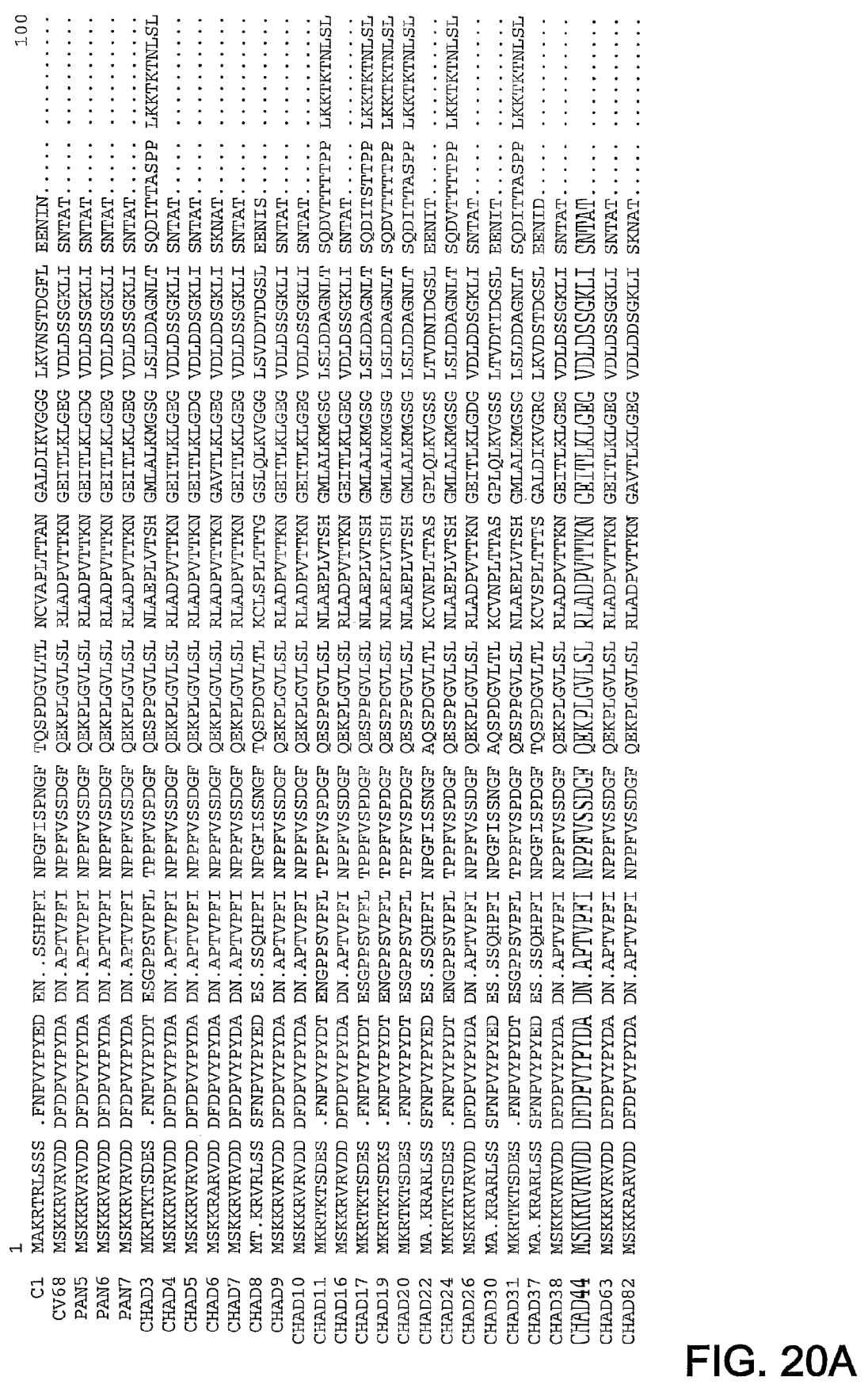
Figure 20B:
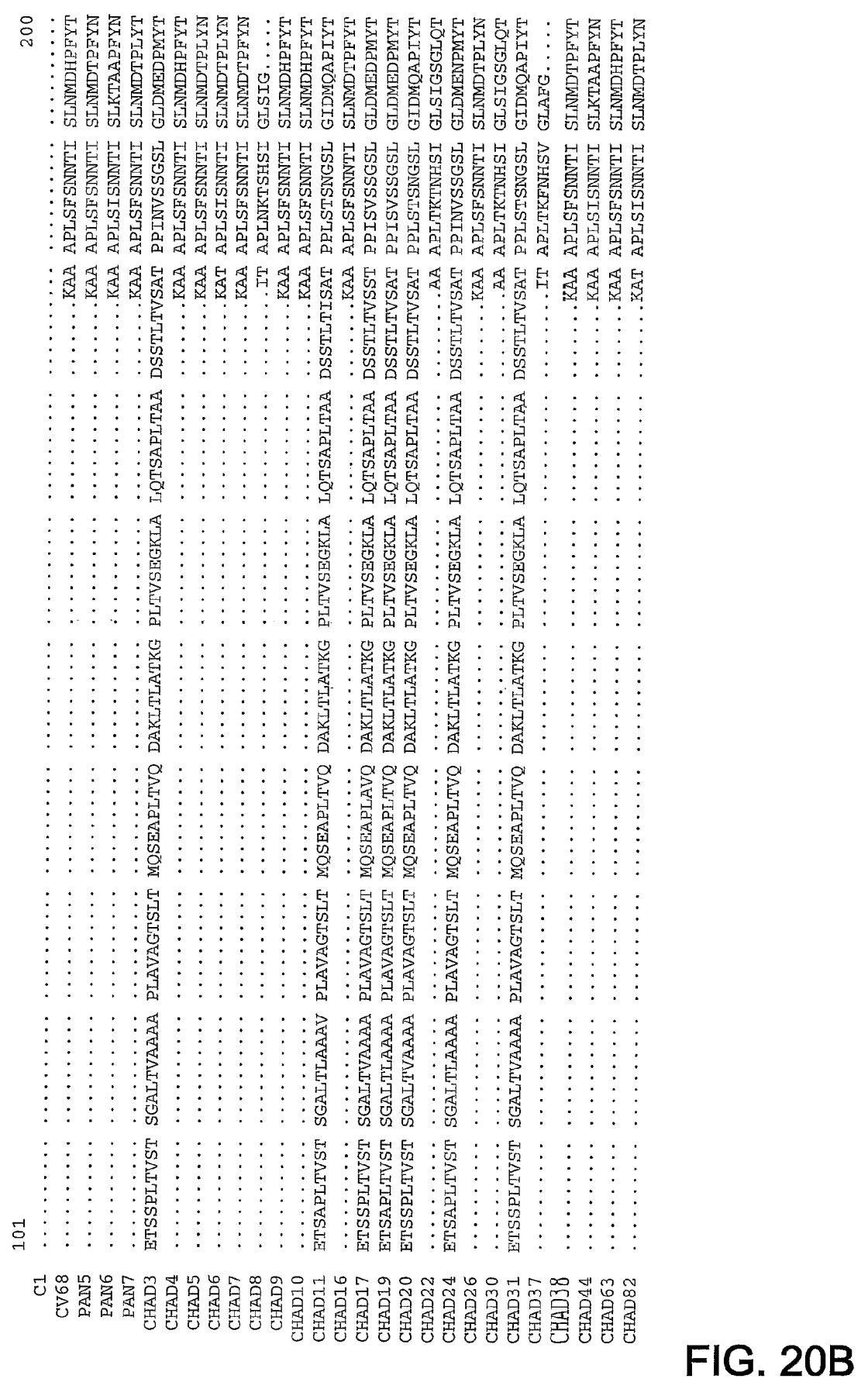
Figure 20E:
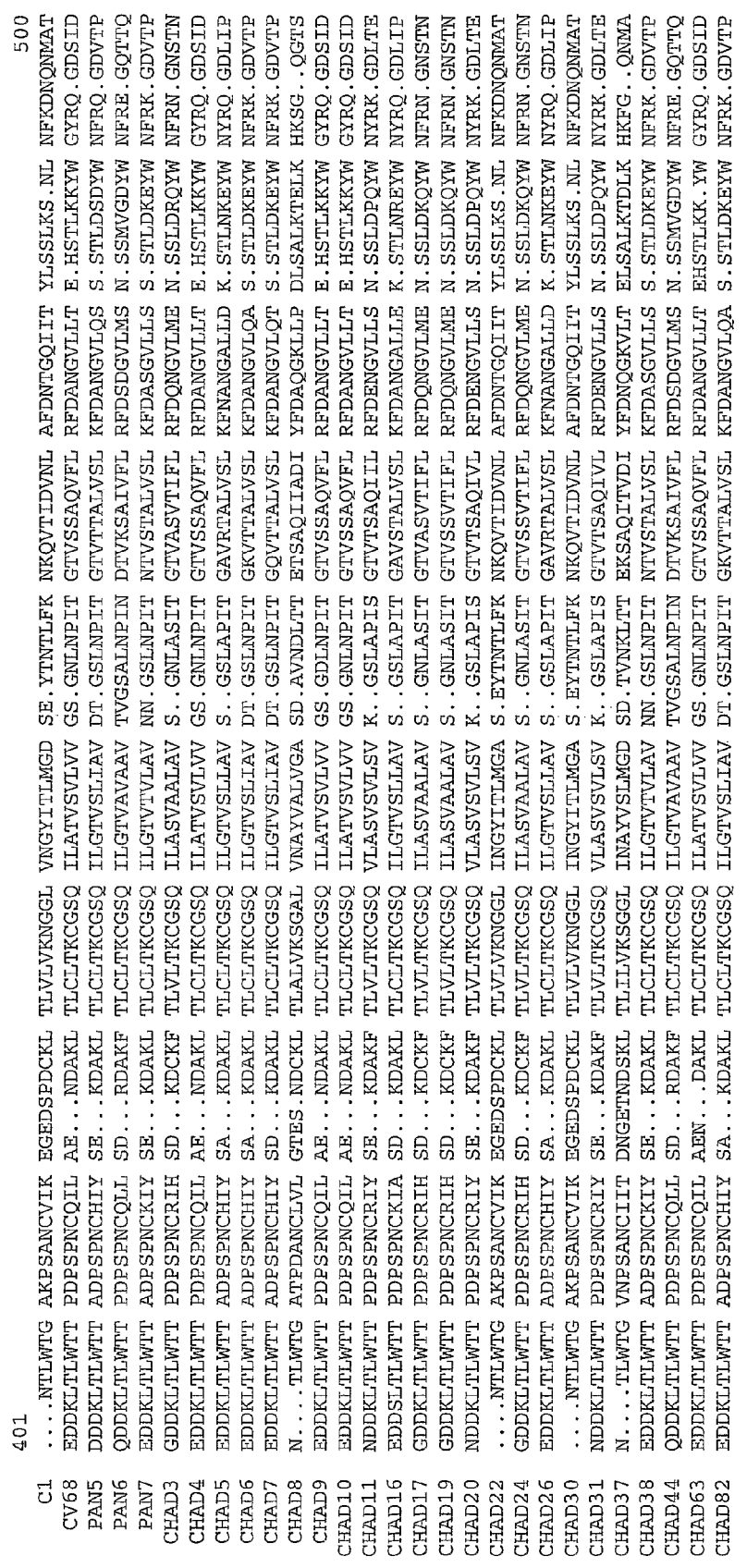

FIGS. 20A-20G provides a comparison of the amino acid sequences of the fiber proteins of: ChAd3, ChAd4, ChAd5, ChAd6, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd63 and ChAd82 with the reference fiber protein sequences from C1 (SEQ ID NO: 85), CV68 (SEQ ID NO: 86), PAN5 (also referred to as CV23) (SEQ ID NO: 80), PAN6 (also referred to as CV32)(SEQ ID NO: 81) and Pan7 (also referred to as CV33) (SEQ ID NO: 82).

FIG. 21 provides the nucleotide sequence of the hexon gene of ChAd20 (SEQ ID NO: 16).

FIG. 22 provides the nucleotide sequence of the hexon gene of ChAd4 (SEQ ID NO: 17).

FIG. 23 provides the nucleotide sequence of the hexon gene of ChAd5 (SEQ ID NO: 18).

FIG. 24 provides the nucleotide sequence of the hexon gene of ChAd7 (SEQ ID NO: 19).

FIG. 25 provides the nucleotide sequence of the hexon gene of ChAd9 (SEQ ID NO: 20).

FIG. 26 provides the nucleotide sequence of the hexon gene of ChAd10 (SEQ ID NO: 21).

FIG. 27 provides the nucleotide sequence of the hexon gene of ChAd11 (SEQ ID NO: 22).

FIG. 28 provides the nucleotide sequence of the hexon gene of ChAd16 (SEQ ID NO: 23).

FIG. 29 provides the nucleotide sequence of the hexon gene of ChAd17 (SEQ ID NO: 24).

FIG. 30 provides the nucleotide sequence of the hexon gene of ChAd19 (SEQ ID NO: 25).

Figure 31I:
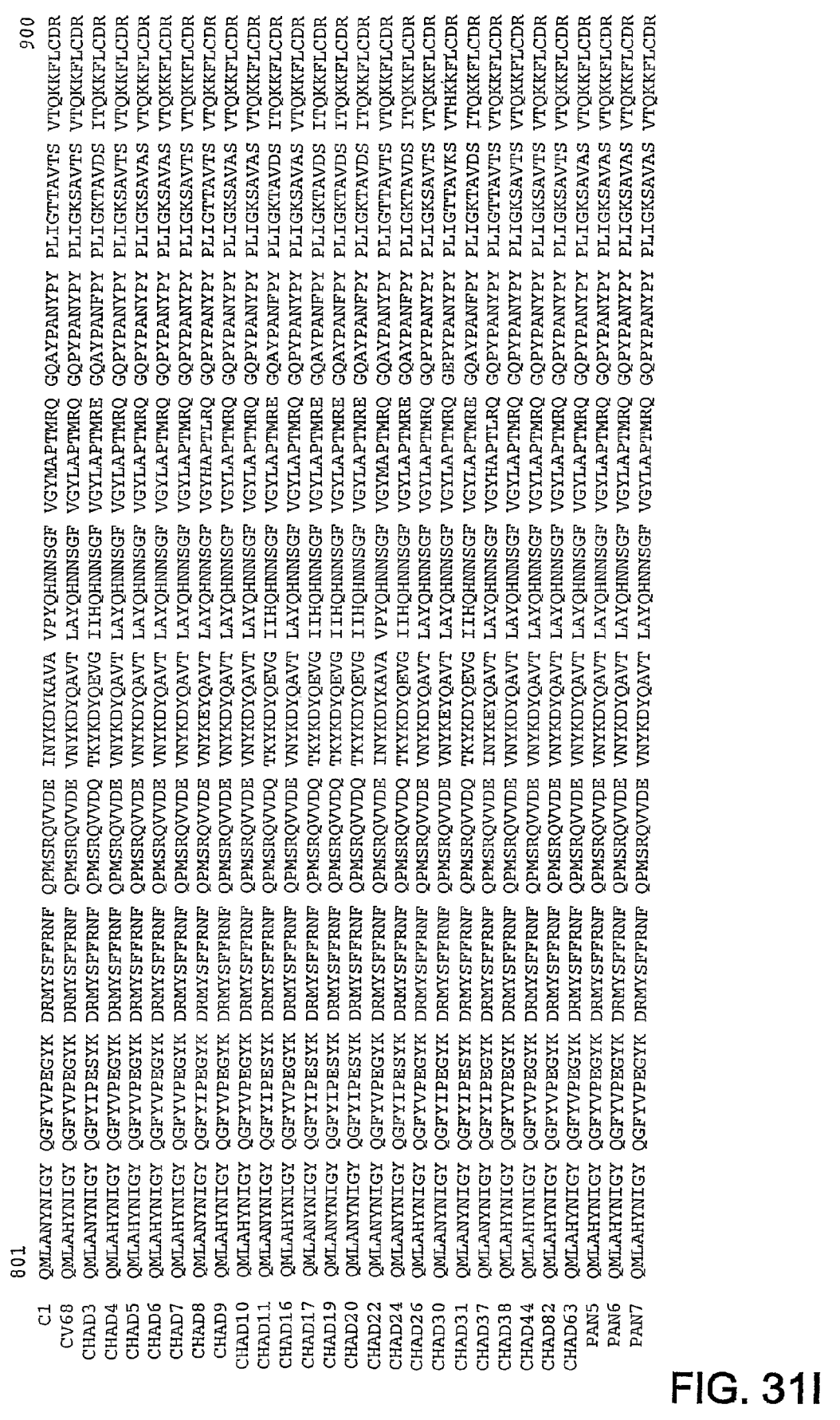

FIGS. 31A-31J provides a comparison of the amino acid sequences of the hexon proteins of ChAd3, ChAd4, ChAd5, ChAd6, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd63 and ChAd82 with the reference fiber protein sequences from C1 (SEQ ID NO: 124), CV68 (SEQ ID NO: 125), PAN5 (also referred to as CV23) (SEQ ID NO: 119), PAN6 (also referred to as CV32) (SEQ ID NO: 120) and Pan7 (also referred to as CV33) (SEQ ID NO: 121).

FIG. 32 provides a listing of the artificial sequences SEQ ID NOS: 26-40 and SEQ ID NOS: 45 and 46, including oligomers and primers, disclosed herein.

DETAILED DESCRIPTION OF THE INVENTION

Figure 1:
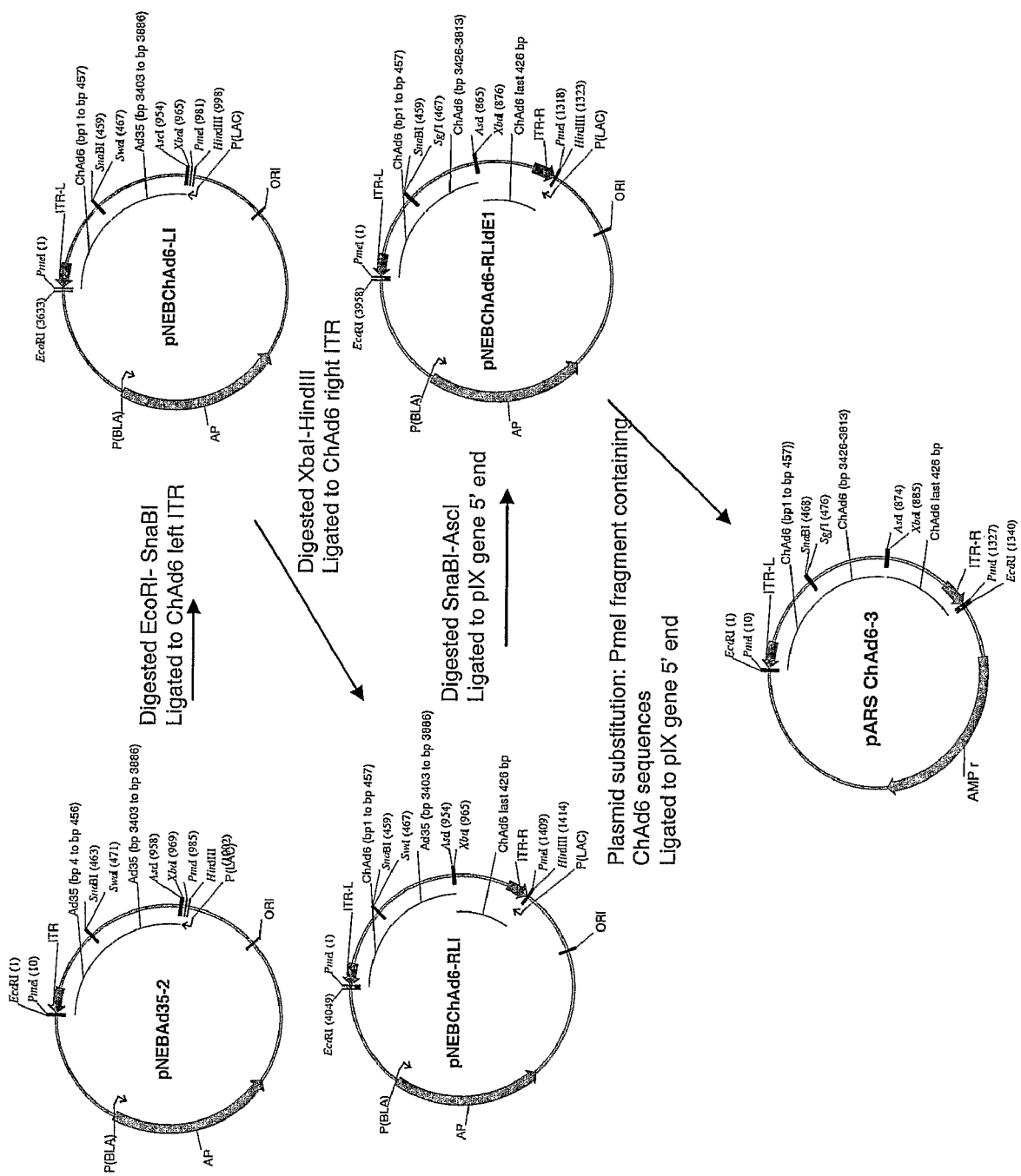
FIG. 1 is a schematic drawing which summarizes the cloning strategy used to construct a ChAd6 shuttle vector (pARS ChAd6-3).

As used throughout the specification and appended claims, the following definitions and abbreviations apply:

The term "cassette" refers to a nucleic acid molecule which comprises at least one nucleic acid sequence that is to be expressed, along with its transcription and translational control sequences. Changing the cassette, will cause the vector into which is incorporated to direct the expression of different sequence or combination of sequences. In the context of the present invention, the nucleic acid sequences present in the cassette will usually encode an immunogen. Because of the restriction sites engineered to be present at the 5' and 3' ends, the cassette can be easily inserted, removed or replaced with another cassette.

The term "cis-acting element" refers to nucleotide sequences which regulate genes to which they are attached. Cis-acting elements present in DNA regulate transcription, and those transcribed into mRNA can regulate RNA processing, turnover and protein synthesis.

The term "vector" refers to some means by which DNA fragments can be introduced into a host organism or host tissue. There are various types of vectors including plasmid, virus (including adenovirus), bacteriophages and cosmids.

The term "promoter" refers to a recognition site on a DNA strand to which an RNA polymerase binds. The promoter forms an initiation complex with RNA polymerase to initiate and drive transcriptional activity. The complex can be modified by activating sequences such as enhancers, or inhibiting sequences such as silencers.

The term "pharmaceutically effective amount" refers to an amount of recombinant adenovirus that is effective in a particular route of administration to transduce host cells and provide sufficient levels of transgene expression to elicit an immune response.

The term "replication-competent" recombinant adenovirus (AdV) refers to an adenovirus with intact or functional essential early genes (i.e., E1A, E1B, E2A, E2B and E4). Wild type adenoviruses are replication competent.

The term "replication-defective" recombinant AdV refers to an adenovirus that has been rendered to be incapable of replication because it has been engineered to have at least a functional deletion, or a complete removal of, a gene product that is essential for viral replication. The recombinant chimpanzee adenoviral vectors of the invention are replication-defective.

The term "mammalian" refers to any mammal, including a human being.

The term "percent sequence identity" or "identical" in the context of nucleic acid sequences refers to the residues in the two sequences that are the same when aligned for maximum correspondence. The length of sequence identity comparison may be over the full-length of the genome (e.g., about 36 kbp), the full-length of an open reading frame of a gene, protein, subunit, or enzyme [see, e.g., the tables providing the adenoviral coding regions], or a fragment of at least about 500 to 5000 nucleotides, is desired. However, identity among smaller fragments, e.g. of at least about nine nucleotides, usually at least about 20 to 24 nucleotides, at least about 28 to 32 nucleotides, at least about 36 or more nucleotides, may also be desired. Similarly, "percent sequence identity" may be readily determined for amino acid sequences, over the full-length of a protein, or a fragment thereof. Suitably, a fragment is at least about 8 amino acids in length, and may be up to about 700 amino acids. Examples of suitable fragments are described herein.

Identity is readily determined using such algorithms and computer programs as are defined herein at default settings. Preferably, such identity is over the full length of the protein, enzyme, subunit, or over a fragment of at least about 8 amino acids in length. However, identity may be based upon shorter regions, where suited to the use to which the identical gene product is being put.

In general, adenoviral constructs, gene constructs are named by reference to the genes contained therein. For example, "pChAd3 ΔE1gag" refers to a plasmid construct which comprises a ChAd3 chimpanzee adenoviral genome deleted of the E1 region. In this plasmid, the E1 region is replaced by an immunogen expression cassette comprising an HIV gag gene under the control of a human CMV promoter followed by a bovine growth hormone polyadenylation signal. Similarly, pCV33DE1-E3 NSmut, refers to a second plasmid construct disclosed herein which comprises a CV33 chimpanzee adenoviral genome, deleted of the E1 and E3 regions, which is replaced by an immunogen expression cassette comprising HCV non-structural genes under the control a human CMV promoter followed by a bovine growth hormone polyadenylation signal.

The abbreviation "Ag" refers to an antigen.

As used throughout the specification and in the appended claims, the singular forms "a," "an," and "the" include the plural reference unless the context clearly dictates otherwise.

Adenoviruses (Ads) are noneveloped, icosahedral viruses that have been identified in several avian and mammalian hosts. Human Ads (hAd) belong to the Mastadenovirus genus which includes all known human and many Ads of animal (e.g., bovine, porcine, canine, murine, equine, simian and ovine) origin. Human adenoviruses are divided into six subgroups (A-F) based on a number of biological, chemical, immunological and structural criteria which include hemagglutination properties of rat and rhesus monkey erythrocytes, DNA homology, restriction enzyme cleavage patterns, percentage G+C content and oncogenicity (Straus, 1984, In *The Adenoviruses*, ed. H. Ginsberg, pps. 451-498, New York: Plenus Press, and Horwitz, 1990 In *Virology*, eds. B. N. Fields and D. M. Knipe, pps. 1679-1721). To date, 51 distinct serotypes have been recognized and grouped into subgroups on the basis of their hemagglutination properties and biophysical and biochemical criteria.

The adenoviral virion has an icosahedral symmetry and, depending on the serotype, a diameter of 60-90 nm. The icosahedral capsid consists three major proteins, hexon (II), penton base (III) and a knobbed fiber (IV) as well as a number of minor proteins (i.e., VI, VIII, IX, IIIa and IVa2) (W. C. Russel, *J. Gen. Virol.*, 81: 2573-2604 (2000). One aspect of the preexisting immunity that is observed in humans is humoral immunity, which can result in the production and persistence of antibodies that are specific for viral proteins. The humoral response elicited by adenovirus is mainly directed against the major structural proteins: hexon, penton and fiber.

Published reports have established that titers comprising antibodies against multiple serotypes are common (Dambrosio, E. (1982) *J. Hyg.* (London) 89: 209-219) and that a substantial portion of the preexisting titers have neutralizing activity. Neutralizing immunity to adenovirus is type specific, and infection with a particular serotype of adenovirus confers immunity only to that serotype. Several reports have suggested that antibodies directed towards the hexon are the strongest and the most neutralizing (Toogood, C. I. A., Crompton, J. and Hay R. T. (1992) *J. Gen. Virol.* 73, 1429-1435). Therefore, it is reasonable to assume that the epitopes responsible for type-specific neutralization are located within seven hypervariable regions identified by alignment of the hexon sequences deriving from different serotypes. (Crawford-Miksza, L and D. P. Schnurr. (1996) *J. Virol.* 70:1836-1844).

A direct correlation between the presence of type-specific neutralizing antibodies and the inability to elicit an immune response with a vector based on the same serotype has been established by different methods including the passive transfer of immune sera from treated to naïve animals. Generally speaking, preexisting humoral immunity for a specific viral serotype reduces the therapeutic efficacy of the vector administration. Moreover, the administration of a-vector based on a specific viral serotype elicits an immune-response against the vector that prevents the re-administration of the same serotype.

In a particular embodiment, the invention provides a method of circumventing the adverse effects associated with the consequences of preexisting immunity to common serotypes of hAds. More specifically, the invention contemplates the use of chimpanzee adenoviral vectors characterized by a serotype that does not circulate in humans. Accordingly, the invention provides adenoviral (Chad) vectors which lack neutralizing B-cell epitopes that cross react with those of common human serotypes as a vaccine carrier.

Although it has been reported that adenoviral-specific cell mediated immunity (CMI) can be cross-reactive, vaccination studies based on repeated injections of multiple serotypes demonstrated a higher efficiency than immunization schedules based on a single vector. These experiments further demonstrate that the main limitation of a vector administration for vaccine purposes is the humoral pre-existing immunity against the vector. Potential solutions to the problems associated with the use of a human adenovirus as a vaccine carrier include the administration of a higher dose of an adenovirus (e.g., a subgroup C serotype) that is predicted to encounter a preexisting immune response, and the use of vectors based on rare human serotypes. However, the use of higher doses of vaccine increases the cost of the vaccine and risk of undesirable side effects and the results of preclinical testing suggest that human alternate serotypes are less immunogenic than hAd5 and hAd6.

In an attempt to avoid the problems of host humoral and cellular immune responses against the adenoviral backbone elements of the vector, and to minimize the risk of using human adenovirus-derived vector stocks that may be contaminated with replication-competent adenoviruses (RCA), several nonhuman adenoviruses have been characterized and developed as vaccine carriers (Soudois, C. et al (2000) *J. Virology,* 74:10639-10649; Farina, S. F. et al (2001) *J. Virology,* 75:11603-11613; Cohen, C. J. et al (2002) *J. Gen. Virology,* 83:151-155.) The premise underlying the use of nonhuman adenoviral sequences to circumvent the problems associated with preexisting immunity is based on the observation that neutralizing antibodies to common human adenovirus serotypes are unlikely to cross-neutralize nonhuman viruses. However, the incompatibility of viral and cellular factors imposes a practical limitation on the vast majority of alternative vector systems (bovine, ovine, canine) which are characterized by the disadvantage of having to be propagated in non-human cell lines.

Wilson et al. have published a report describing the characterization of a replication-defective vector based on chimpanzee adenovirus type 68 (CV68) C68, which was originally isolated from a mesenteric lymph node of a chimpanzee (Basnight, M., et. al. (1971) *Am. J. Epidemiol.* 94:166-171), CV68 was fully sequenced and found to be similar in overall structure to human adenoviruses (Farina, S. F. et al., *J. Virol.* 75(23): 11603-11613 (2001). The genome of the virus is 36,521 base pairs in length and has been described as being most similar to subgroup E of human adenoviruses, with 90% identity to most human Ad4 open reading frames that have been sequenced. The CV68 ITRs are 130 base pairs in length, and all of the major adenoviral early and late genes are present. CV68 is characterized by a serotype that does not circulate in humans and which lacks neutralizing B cell epitopes that cross-react with those of common human serotypes. Although Chimpanzee adenonviruses are similar to human adenoviruses cross-reactive neutralizing immunity against chimpanzee serotypes has not been documented in humans (Farina, S. F. et al. *J. Virol.* (2001) 75(23):11603-13).

The recombinant vectors derived from CV68 are described as being sufficiently similar to human serotypes to support transduction of cells expressing the coxsackievirus and adenovirus receptor (Cohen, C. et al., *J. Gen. Virol.* 83: 151-155 (2002). Significantly, CV68 is characterized by a sufficient level of similarity to human adenoviruses to support its replication 293 cells which harbor E1 from human adenovirus type 5 (Farina, S. F. et al., *J. Virol.* 75(23): 11603-11613 (2001). Furthermore, based on the observation that the flanking sequences of the human serotype 5 E1 are nonhomologous with those of the CV68-derived vector sequences, it is predicted that homologous recombination will not occur. Thus, it has been predicted that there is a low likelihood that CV68-derived vaccine stocks will be contaminated with RCA.

The same group of investigators subsequently reported the use of CV68-derived adenoviral sequences as a vaccine carrier for induction of antibodies to the rabies virus glycoprotein in mice. A replication-defective version of CV68 was created by replacing the E1A and E1B genes with a minigene cassette. Mice immunized with an E1-deletion-containing adenoviral recombinant (AdC68rab.gp) comprising a transgene product encoding the rabies virus glycoprotein developed protective immunity to rabies virus and remained resistant to challenge with an otherwise lethal dose of rabies virus (Xiang, Z et al., *J. Virol.* 76(5): 2667-2675 (2002). A second CV68 construct expressing a codon-optimized, truncated form of gag of HIV-1 was recently reported to induce a vigorous gag-specific $CD8^+T$ cell response in mice. The vaccine-induced response was shown to provide protection to challenge with a vaccinia gag recombinant virus (Fitzgerald, J. C. et al., *J. Immunol.* 170: 1416-1422 (2003). Experimental vaccination of mice preimmunized to human adenovirus serotype 5 with CV68gag or Ad5gag vectors demonstrated a more pronounced reduction of gag-specific T cells and protection against viral challenge elicited by Ad5 than by CV68 vaccine. The reduction in efficacy of C68gag vaccine was attributed to a cross-reactivity of Ad5-specific CD8+ T cells (Id.).

Figure 36:
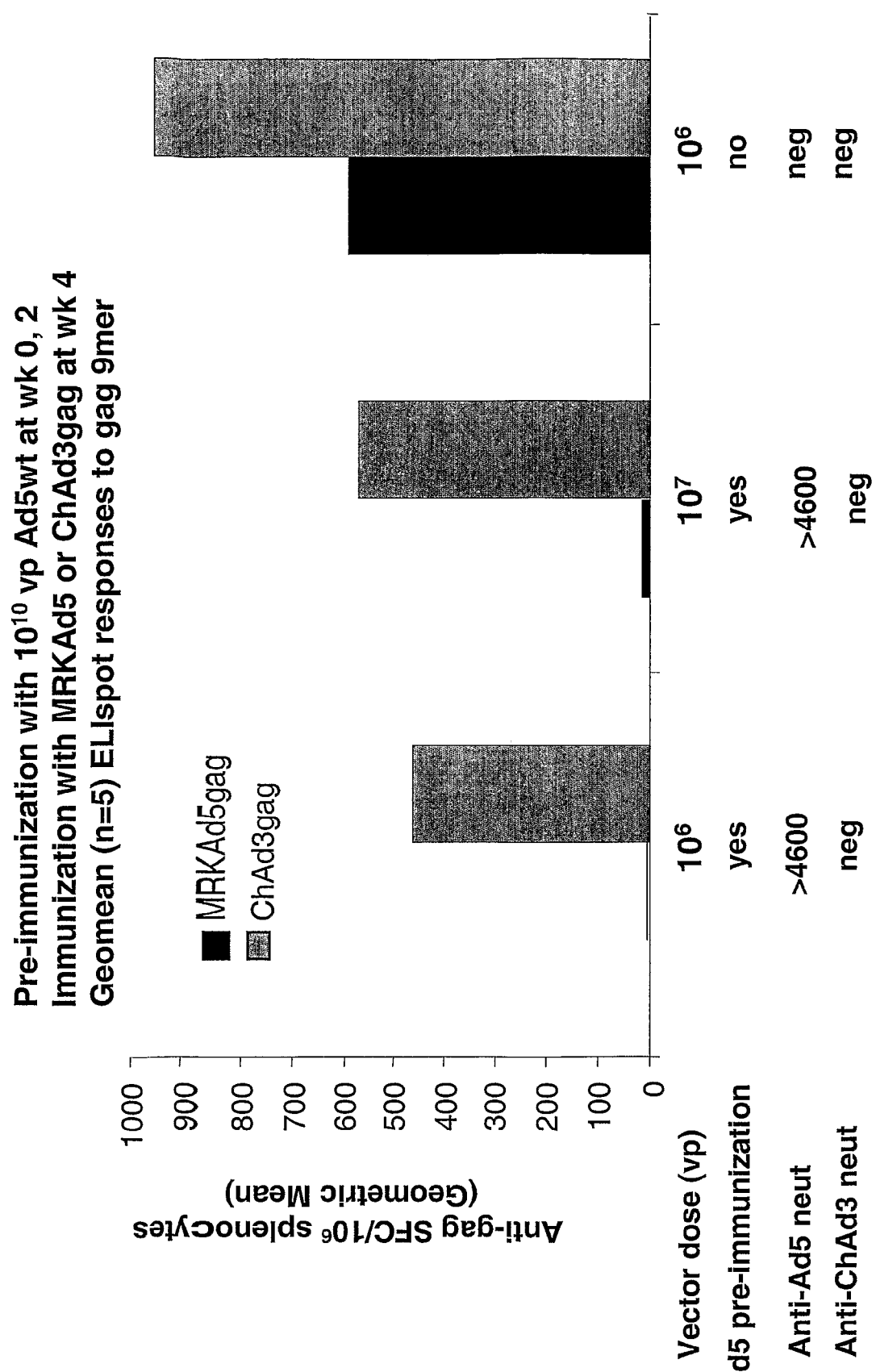
FIG. 36 is a graphic representation of immunization results obtained in response to the administration of ChAd3 and hAd5 gag vectors to mice which were pre-exposed to hAd5. Cell-mediated immunity was evaluated 3 weeks post-immunization by IFN-γ ELISPOT using purified splenocytes.

Considered together this data suggests that simian-derived replication-defective adenoviral vectors may be more suitable for use as human vaccine carriers than vectors based on common human serotypes. As shown herein, the results of experiments in which mice that were strongly immunized against human Ad5 (FIG. 36) can be immunized with ChAd3-gag adenoviral vectors indicate the preexisting anti-human Ad5 immunity did not reduce the gag-specific CMI response elicited by the ChAd vectors. These results are consistent with the conclusion that human Ad5 cross-reactive B and T-cell epitopes are not present in ChAd3- or ChAd6 vectors.

Generally speaking, the adenoviral genome is very well characterized and despite the existence of several distinct serotypes, there is some general conservation in the overall organization of the adenoviral genome with specific functions being similarly positioned. The nucleotide sequences of the chimpanzee adenoviruses C1 and CV68 disclosed by Wilson et al., and the location of the E1A, E1B, E2A, E2B, E3, E4, L1, L2, L3, L4 and L5 genes of each virus are provided in U.S. Pat. No. 6,083,716 (Chimpanzee Adenovirus Vectors), and PCT published application WO 03/000851 (Methods for Rapid Screening of Bacterial Transformants and Novel Simion Adenoviral Proteins), the teachings of which are incorporated herein by reference.

Each extremity of the adenoviral genome comprises a sequence known as an inverted terminal repeat (ITRs), which is necessary for viral replication. The virus also comprises a virus-encoded protease, which is necessary for processing some of the structural proteins required to produce infectious virions. The structure of the adenoviral genome is described on the basis of the order in which the viral genes are expressed following host cell transduction. More specifically, the viral genes are referred to as early (E) or late (L) genes according to whether transcription occurs prior to or after onset of DNA replication. In the early phase of transduction, the E1, E2, E3 and E4 genes of adenovirus are expressed to prepare the host cell for viral replication. The virus can be rendered replication defective by deletion of the essential early-region 1(E1) of the viral genome. Brody et al, 1994 *Ann NY Acad Sci.*, 716:90-101. During the late phase, expression of the late genes L1-L5, which encode the structural components of the virus particles is switched on. All of the late genes are under the control of a single promoter and encode proteins including the penton (L2), the hexon (L3), the 100 kDa scaffolding protein (L4), and the fiber protein (L5), which form the new virus particle into which the adenoviral DNA becomes encapsidated. Depending on the serotype of the virus, 10,000-100,000 progeny adenovirus particles can be generated in a single host cell. Ultimately, the adenoviral replication process causes lysis of the cells.

The replication-defective adenoviral vectors disclosed herein were constructed by deletion of specific nucleotide sequences from the disclosed chimpanzee nucleic acid sequences and insertion of sequences derived other DNA sequences that are useful for transgene insertion, expression or other genetic manipulations. Accordingly, the recombinant chimpanzee adenoviruses described herein may contain adenoviral sequences derived from one or more chimpanzee adenoviruses, or sequences from a chimpanzee adenovirus and from a human adenovirus. Suitable polynucleotide sequences can be produced recombinantly, synthetically or isolated from natural sources. Adenoviral sequences suitable for use in particular aspects of the invention include sequences which lack neutralizing B-cell epitopes that are cross-reactive with common human serotypes.

At a minimum, the recombinant chimpanzee adenovirus (e.g., vector) of the invention contain the chimpanzee adenovirus cis-acting elements necessary for replication and virion encapsidation, in combination with at least one immunogen expression cassette. Typically, the cis-acting elements flank the expression cassette which comprises a transgene that encodes at least one antigen. More specifically, the vectors of the invention contain the requisite cis-acting 5' inverted terminal repeat (ITR) sequences of the adenoviruses (which function as origins of replication), 3' ITR sequences, packaging/enhancer domains, and a nucleotide sequence encoding a heterologous molecule. Regardless of whether the recombinant vector comprises only the minimal adenoviral sequences or an entire adenoviral genome with only functional deletions in particular genes (e.g., the E1 and/or E3 or E4 regions), the vectors of the invention comprise a chimpanzee adenovirus capsid.

Generally, speaking the adenoviral vectors disclosed herein comprise a replication-defective adenoviral genome, wherein the adenoviral genome does not have a functional E1 gene, and an immunogen expression cassette which comprises: a) a nucleic acid encoding at least one immunogen against which an immune response is desired; and b) a heterologous (i.e., with respect to the adenoviral sequence) promoter operatively linked to the nucleic acid sequence encoding the immunogen(s); and a transcription terminator.

More specifically, the invention provides replication-defective vectors that consist of a recombinant adenoviral genome that is devoid of at least one early gene selected from the group consisting of E1, E2, E3, and E4. In one embodiment, a replication-defective vector is prepared by replacing, or disrupting, the E1 gene of one of the adenoviral isolates disclosed herein (e.g., ChAd3, ChAd6, ChAd4, ChAd5, ChAd7, ChAd9, ChAd10, ChAd11, ChAd16, ChAd17, ChAd19, ChAd20, ChAd8, ChAd22, ChAd24, ChAd26, ChAd30, ChAd31, ChAd37, ChAd38, ChAd44, ChAd63 or ChAd82) with an immunogen expression cassette. For example, a vector can be prepared by deleting/disrupting the E1 gene of ChAd3 (SEQ ID NO:1) or ChA6 (SEQ ID NOS: 2). Alternatively, a replication-defective vector can be prepared from any one of the other adenovirus isolates disclosed herein, including ChAd3, ChAd6, ChAd4, ChAd5, ChAd7, ChAd9, ChAd10, ChAd11, Chad16, Chad17, ChAd19, ChAd8, ChAd22, ChAd24, ChAd26, ChAd30, ChAd31, ChAd37, ChAd38, ChAd44, ChAd63 and ChAd82 or ChAd20. In other embodiments, replication-defective vectors of the invention comprises an adenoviral genome derived from one of the ChAds disclosed herein that has been optionally engineered to lack a functional E3 gene. It is to be understood that the chimpanzee adenoviral sequences disclosed herein can be rendered replication-defective by either completely removing an early gene or by rendering the gene inoperative or nonfunctional.

It is to be understood that the invention encompasses vectors that are characterized as having modifications, such as a "functional deletion" which destroys the ability of the adenovirus to express one or more selected gene products. The phrase "functional deletion" as used herein broadly encompasses modifications that have the effect of rendering a particular gene product nonfunctional. Generally speaking, functional deletions take the form of a partial or total deletion of an adenoviral gene. However, one of skill in the art will readily acknowledge that other manipulations, including but not limited to making a modification which introduces a frame shift mutation, will also achieve a functional deletion. For example, the recombinant chimpanzee adenoviral vectors of the invention can be rendered replication-defective by introducing a modification that is designed to interfere with, or to functionally delete, the ability of the virus to express adenoviral E1A and/or E1B.

It is well-known that replication-defective adenoviral vectors can be obtained by introducing a modification that is designed to interfere with, or to functionally delete the expression of one or more genes from the group of E2 genes. More in detail, a replication-defective vector can be constructed by inactivating the polymerase gene, or the preterminal protein gene or the DNA binding protein gene. Moreover deletion or inactivation of genes expressed by E4 region is an alternative strategy to construct replication-defective chimp Ad vectors. Early gene deletion or inactivation can be combined in order to produce more attenuated vectors. Alternatively, replication-defective ChAd vectors can also comprise additional modifications in other viral genes, such as the late genes L1 through L5. In addition, novel adenoviral vaccine carriers can be generated by combining hexon and fiber genes obtained from different serotypes. The utilization of a hexon and fiber gene shuffling strategy will also allow an investigator to change the biological properties of a ChAd and facilitate the production of vectors with a different tropism or with new serological characteristics.

It is to be understood that the present invention encompasses recombinant adenoviral vectors comprising deletions of entire genes or portions thereof which effectively destroy the biological activity of the modified gene either alone or in any combination. For example, recombinant simian adenoviruses can be constructed which have a functional deletion of the genes expressed by E4 region, although as shown herein it may be desirable to introduce the heterologous Ad5 E4 sequence into the vector in combination with the functional deletion of an E1 gene. Alternatively, the function of the adenoviral delayed early E3 gene may be eliminated; however because the function of E3 is not necessary for the production of a recombinant adenoviral particle it is not necessary to replace this gene product in order to produce a recombinant that is capable of packaging a virus useful in the invention.

In one embodiment of this invention, the replication-defective adenoviral vector used is a chimpanzee subgroup C adenovirus containing deletions in E1 and optionally in E3. For example, for ChAd3, a suitable E1 deletion/disruption can be introduced in the region from bp 460 to bp 3542 (with reference to SEQ ID NO: 1). For ChAd6, a suitable E1 deletion/ disruption can be introduced in the region from bp 457 to bp 3425 (with reference to SEQ ID NO: 2). For CV32, the E1 deletion is preferably from bp 456 to bp 3416 (with reference to SEQ ID NO: 3); for CV33, the E1 deletion is preferably from bp 456 to bp 3425 (with reference to SEQ ID NO: 4) and for CV23, the E1 deletion is preferably from bp 456 to bp 3415 (with reference to SEQ ID NO: 5). E3 deletions for CV32 and CV33 are preferably from bp 27446 to bp 31911 (with reference to SEQ ID NO: 3); from bp 27146 to bp 31609 (with reference to SEQ ID NO: 4) respectively. Those of skill in the art can easily determine the equivalent sequences for other chimpanzee isolates based on sequence homologies and multiple sequence alignments.

One of skill in the art will readily acknowledge that in order to construct an E1-deleted adenoviral vector a number of decisions must be made regarding the structure of the vector backbone and the composition of the nucleic acid sequence comprising the transgene. For example, an investigator must determine if the size of the E1 deletion will accommodate the size of the transgene. If not, then additional deletions will have to be introduced into the backbone of the vector.

The nucleic acid sequence embodying the transgene can be a gene, or a functional part of a gene and will typically exist in the form of an expression cassette. Typically a gene expression cassette includes: (a) nucleic acid encoding a protein or antigen of interest; (b) a heterologous promoter operatively linked to the nucleic acid encoding the protein; and (c) a transcription termination signal. The nucleic acid can be DNA and/or RNA, can be double or single stranded. The nucleic acid can be codon-optimized for expression in the desired host (e.g., a mammalian host).

Decisions must also be made regarding the site within the backbone where the transgene will be introduced and the orientation of the transgene. More specifically, the transgene can be inserted in an E1 parallel (transcribed 5' to 3') or anti-parallel (transcribed in a 3' to 5' direction relative to the vector backbone) orientation. In addition, appropriate transcriptional regulatory elements that are capable of directing expression of the transgene in the mammalian host cells that the vector is being prepared for use as a vaccine carrier in need to be identified and operatively linked to the transgene. "Operatively linked" sequences include both expression control sequences that are contiguous with the nucleic acid sequences that they regulate and regulatory sequences that act in trans, or at a distance to control the regulated nucleic acid sequence.

Regulatory sequences include: appropriate expression control sequences, such as transcription initiation, termination, enhancer and promoter sequences; efficient RNA processing signals, such as splicing and polyadenylation signals; sequences that enhance translation efficiency (e.g., Kozak consensus sequences); sequences that enhance protein stability, and optionally sequences that promote protein secretion. Selection of these and other common vector elements are conventional and many suitable sequences are well known to those of skill in the art (see, e.g., Sambrook et al, and references cited therein at, for example, pages 3.18-3.26 and 16.17-16.27 and Ausubel et al., Current Protocols in Molecular Biology, John Wiley & Sons, New York, 1989).

In specific embodiments, the promoter is a heterologous promoter (i.e., with respect to the adenovirus sequences) which is recognized by an eukaryotic RNA polymerase. In a preferred embodiment, the promoter is a "strong" or "efficient" promoter. An example of a strong promoter is the immediate early human cytomegalovirus promoter (Chapman et al, 1991 *Nucl. Acids Res* 19:3979-3986, which is incorporated by reference). The human CMV promoter can be used without (CMV) or with the intron A sequence (CMV-intA), although those skilled in the art will recognize that any of a number of other known promoters, such as the strong immunoglobulin, or other eukaryotic gene promoters may be used, including the EF1 alpha promoter, the murine CMV promoter, Rous sarcoma virus (RSV) promoter, SV40 early/ late promoters and the beta-actin promoter.

Further examples of promoters that can be used in the present invention are the strong immunoglobulin promoter, the EF1 alpha promoter, the murine CMV promoter, the Rous Sarcoma Virus promoter, the SV40 early/late promoters and the beta actin promoter, albeit those of skill in the art can appreciate that any promoter capable of effecting expression in the intended host can be used in accordance with the methods of the present invention. The promoter may comprise a regulatable sequence such as the Tet operator sequence. Sequences such as these that offer the potential for regulation of transcription and expression are useful in instances where repression of gene transcription is sought.

Suitable gene expression cassettes will also comprise a transcription termination sequence. A preferred transcriptional terminator is the bovine growth hormone terminator. The promoter/transcription termination combination of CMVintA-BGH terminator is particularly preferred although other promoter/terminator combinations may also be used. As shown herein, the bovine growth hormone termination/ polyadenylation signal (bGHpA) or short synthetic polyA signal (SPA) of 50 nucleotides in length defined as follows:

(SEQ ID NO: 26)
AATAAAAGATCTTTATTTTCATTAGATCTGTGTGTTGGTTTTTTGTGTG.

Generally speaking, exemplify suitable termination sequences. The polyA signal is inserted following the nucleic acid sequence which comprises the transgene and before the 3' adenovirus ITR sequence.

The recombinant adenoviral vectors described herein may contain adenoviral sequences derived from one or more strain of adenovirus. Suitable sequences may be obtained from natural sources, produced recombinantly, synthetically, or by other genetic engineering or chemical methods. In a particular embodiment, the recombinant chimpanzee adenovirus is a chimeric recombinant comprising non-chimpanzee adenoviral polynucleotide sequences. Suitable non-chimpanzee adenoviral sequences can be obtained from human adenoviral strains. For example, the native E4 region can be replaced by hAd5 E4 (Ad5 nt 32816 to nt 35619) or by Ad5E4orf6 (Ad5 nt 33193 to nt 34077) (Ad5 GenBank Accession No: M73260).

Generally speaking, the immunogen (antigenic molecule) delivered by the recombinant adenoviral vector of the invention comprises a polypeptide, protein, or enzyme product which is encoded by a transgene in combination with a nucleotide sequence which provides the necessary regulatory sequences to direct transcription and/or translation of the encoded product in a host cell. The composition of the transgene depends upon the intended use of the vector. For example, if the immunogenic composition is being designed to elicit an antibody response or a cell-mediated immune response in a mammalian host which is specific for an infectious agent, then it is appropriate to utilize a nucleic acid sequence encoding at least one immunogenic product that is predicted to confer pathogen-specific immunity to the recipient. Alternatively, if the composition is being prepared for use as a cancer vaccine, a suitable transgene may comprise an immunogenic portion of a self-antigen, such as a TAA, which has been selected with the goal of eliciting a protective immune response of sufficient potency to both break host tolerance to a particular TAA and to elicit a long-lived (e.g., memory) response that will be sufficient to prevent the initiation of cancer or to prevent tumor progression. Accordingly, suitable immunogenic gene products may be obtained from a wide variety of pathogenic agents (such as, but not limited to viruses, parasites, bacteria and fungi) that infect mammalian hosts, or from a cancer or tumor cell. Although, the invention is illustrated herein with a particular set of test immunogens it is to be understood that the invention is not limited to the use of the antigens exemplified herein. More specifically, the invention contemplates the use of both heterologous and self-antigens as immunogens, including but not limited to TAAs.

In one embodiment, the invention provides an immunogenic composition (e.g., a vaccine) for inducing an immune response against antigens (i.e., immunogens) expressed by an infectious agent. For example, it is desirable to elicit an immune response against a virus infecting humans and/or non-human animal species. Examples of virus families against which a prophylactic and/or therapeutic immune response would be desirable include the Picornaviridae family which includes six different genera such as Aphtovirus, Cardiovirus, Enterovirus, Hepatovirus, Parechovirus, Rhinovirus. Examples of Picornavirus against which an immune response would be desirable are: Foot-and-mouth disease viruses, Encephalomyocarditis viruses, Polioviruses, Coxackieviruses, Human hepatitis A virus, Human parechoviruses, Rhinoviruses. Caliciviridae family includes different genera associated with epidemic gastroenteritis in humans caused by the Norwalk group of viruses and other syndromes in animals like the hemorrhagic disease in rabbits associated with rabbit hemorrhagic disease virus or respiratory disease in cats caused by feline calicivirus.

Another family of viruses, against which it may be desirable to elicit an immune response is the Astroviridae which comprises viruses isolated from humans as well as many different animal species. Human astroviruses are associated with gastroenteritis and young children diarrhea. Alternatively, it may be desirable to confer mammalian hosts with immunity to members of the Togaviridae family of viruses which comprises two genera: alphavirus and rubivirus. Alphaviruses are associated with human and veterinary diseases such as arthritis (i.e. Chikungunya virus, Sindbis virus) or encephalitis (i.e. Eastern Equine Encephalitis Virus, Western Equine Encephalitis Virus).

Rubella virus provides an alternative viral target against which is the only member of the Rubivirus genus is responsible for outbreaks of a mild exanthematic disease associated with fever and lymphoadenopathy. Rubella virus infection is also associated with fetus abnormalities when acquired by mother during in early pregnancy. Flaviviridae is another virus family consisting of three genera: the flaviviruses, the pestiviruses and the hepaciviruses that includes important human as well as animal pathogens. Many of the flavivirus genus members are arthropod-borne human pathogens causing a variety of diseases including fever, encephalitis and hemorrhagic fevers. Dengue Fever Viruses, Yellow Fever Virus, Japanese Encephalitis Virus, West Nile Fever Virus, Tick-borne Encephalitis Virus are pathogens of major global concern or of regional (endemic) concern. Pestivirus genus includes animal pathogens of major economic importance such as Bovine Viral Diarrhea Virus, Classical Swine Fever Virus, Border Disease Virus. Hepatitis C Virus is the only member of the Hepacivirus genus responsible for acute and chronic hepatitis. HCV proteins expressed by a recombinant adenovirus can elicit a protective as well as therapeutic immune response limiting the consequences of a viral infection affecting 170 million people worldwide.

Alternatively, antigens derived from members of the Coronaviridae family can be expressed by recombinant adenovirus vectors in order to obtain protection against infection. Protection against the severe acute respiratory syndrome coronavirus (SARS-Co Virus) can be obtained by immunizing with one or more chimpanzee adenovirus chosen from the group including ChAd3, 4, 5, 6, 7, 9, 10, 11, 16, 17, 19, 20, ChAd8, ChAd22, ChAd24, ChAd26, ChAd30, ChAd31, ChAd37, ChAd38, ChAd44, ChAd63 and ChAd82 expressing one or more SARS-CoV protein including without limitations nucleocapsid (N) protein, polymerase (P) protein, membrane (M) glycoprotein, spike (S) glycoprotein, small envelope (E) protein or any other polypeptide expressed by the virus. Rhabdoviridae family members including rabies virus can be target of recombinant vaccine expressing viral proteins.

Other possible targets include the Filoviridae family comprising Ebola-like viruses and Marburg-like viruses genera, that is responsible of outbreaks of severe hemorrhagic fever; the Paramyxoviridae family comprising some of the most prevalent virus known in humans like measles, respiratory syncytial, parainfluenza viruses and viruses of veterinary interest like Newcastle disease and rinderpest viruses; the Orthomyxoviridae family including Influenza A, B, C viruses; Bunyaviridae family mainly transmitted by arthropod to vertebrate hosts comprising important human pathogens like Rift valley fever, Sin Nombre, Hantaan, Puumala viruses; Arenaviridae family comprising Lymphocytic choriomeningitis, Lassa fever, Argentine Hemorragic fever, Bolivian Hemorragic fever viruses; Bornaviridae family comprising viruses causing central nervous system diseases mainly in horses and sheep; Reoviridae family including rotaviruses, the most important cause of severe diarrheal illness in infants and young children worldwide, orbiviruses that can affect both humans and other mammals (bluetongue, epizootic hemorrhagic disease viruses); Retroviridae family, a large group of viruses comprising important human pathogens like human immunodeficiency virus 1 and 2 (HIV-1 and HIV-2) and human t-cell leukemia virus type 1 and 2 (HTLV 1 and 2) as well as non-human lentivirus such as Maedi/Visna viruses affecting sheep and goats, Equine infectious anemia virus affecting horses, bovine immunodeficiency virus affecting cattle, feline immunodeficiency virus affecting cats; Polyomaviridae family groups small DNA oncogenic viruses, prototype viruses are polyoma and SV40 infecting mouse and rhesus monkey respectively, (BK and JC viruses closely related to SV40 were isolated from human patients); Papillomaviridae family consists of a group of DNA viruses infecting higher vertebrates including humans generating warts and condylomas. Papilloma viral infection is associated with the development of cancer in both humans and animals. Human papilloma viruses are associated with cervical cancer, vaginal cancer and skin cancer. The herpesviridae families includes subfamilies in which are classified a number of important pathogens for humans and other mammals. Suitable sources of antigens can be but are not limited to herpes simplex viruses 1 and 2, varicella-zoster virus, Epstein-Barr virus, Cytomegalovirus, human herpesviruses 6A, 6B and 7, Kaposi's sarcoma-associated herpesvirus. Further suitable source of antigens are members of the Poxviridae family like Monkeypox virus, Molluscum contagiusum virus, smallpox virus; Hepatitis B virus, the prototype member of the hepadnaviridae family as well as other virus causing acute and/or chronic hepatitis like hepatitis delta virus, hepatitis E virus.

The adenoviral vectors of the present invention are also suitable for the preparation of immunogenic compositions designed to stimulate an immune response in humans or animals against protein expressed by non-viral pathogens including bacteria, fungi, parasites pathogens. For example, the vectors disclosed herein can be used to prepare vaccines against, but not limited to: *Staphylococcus aureus, Streptococcus pyogenes, Streptococcus pneumoniae, Vibrio cholerae, Clostridium tetani, Neisseria meningitis, Corynebacterium diphteriae, Mycobacteria tuberculosis* and *leprae, Listeria monocytogenes*, and *Legionella pneumofila*. Examples of fungi and mammalian parasites for which it may be desirable to prepare prophylactic or therapeutic vaccines include: *Candida albicans, Aspergillus fumigatus, Histoplasma capsulatum, Plasmodium malariae, Leishmania major, Trypanosome cruzi* and *brucei, Schistosoma haematobium, mansoni* and *japonicum; Entamoeba histolytica*, and numerous species of Filaria known to be responsible for human filariasis.

Cancer typically involves the deregulation of genes that encode polypeptides which contribute to maintaining cell cycle or controlling cell proliferation (e.g., growth factors, oncogenes, receptors and tumor suppressors). The products of many of the genes implicated in cancer are expressed on the surface of a wide variety of tumor cells. A variety of tumor antigens that may be recognized by T and B lymphocytes have been identified in human and animal cancer. The vast majority of human tumor-associated antigens (TAAs) that are suitable for use in an anticancer vaccine trial are described as "self-antigens" due to the fact that in addition to being expressed on tumor cells they also are expressed on normal tissue and/or during fetal development. Immunotolerance of the target population to TAAs may explain why many cancer vaccines have proven to be ineffective.

Tumor antigens can be produced by oncogenic mutants of normal cellular genes altered proto-oncogenes or tumor suppressor genes such as Ras, p53 or Bcr-Abl protein are examples of altered cellular proteins that can stimulate T/B cell response. Tumor antigens can be normal cellular proteins that are overexpressed in tumor cells (tyrosinase, GP100, MART are normally expressed at low levels in melanocytes and overexpressed in melanoma) or aberrantly expressed in tumor cells (MAGE, BAGE, GAGE expressed in melanomas and many carcinomas but normally expressed in the testis and placenta). Tumor antigens can be products of oncogenic viruses: papillomavirus E6 and E7 proteins expressed by cervical carcinomas; EBV EBNA-1 protein produced by EBV+ lymphomas and nasopharyngeal carcinomas; SV40 T antigen in SV40 induced experimental tumors. Oncofetal antigens are expressed to high levels on cancer cells and in normal developing (fetal) tissues but not in adult tissues. Carcinoembryonic antigen (CEA) and alpha-fetoprotein (AFP) are examples of well characterized oncofetal antigens.

Recent evidence supports the existence of TAAs that are capable of eliciting an immune response, thus making this class of antigens suitable immunogens for vaccine therapy. However, as a class of antigens TAAs are notoriously poor immunogens and T cells that are highly specific for TAAs are either deleted or anergized during T-cell development. Accordingly, there is an expectation that the immune response of a tumor-bearing host to a particular TAA will be extremely weak. Because of the inherent need to break host tolerance to a target TAA experimental clinical vaccine studies are particularly focused on developing immunization strategies that will enhance TAA-specific T-cell responses. Generally, speaking an effective cancer vaccine must both overcome immunotolerance and enhance host's immune response to a level that is preventative and/or protective. Anti-tumor effects in many experimental vaccine studies have been correlated with T-cell responses to TAAs.

In an alternative embodiment, the invention contemplates an immunogenic composition (e.g., a cancer vaccine) which can be used to induce an immune response against tumor antigens. A suitable composition would contain a recombinant chimpanzee adenovirus comprising nucleic acid sequence encoding a tumor antigen and a physiologically acceptable carrier. In a particular embodiment, the coding sequence element of the cassette may encode a single immunogen, such as an immunogenic peptide sequence derived from a self-antigen, such as a tumor-associated antigen. In some embodiments, the nucleic acid sequence encoding the immunogen (i.e., the transgene) may be codon optimized for expression in a particular mammalian species. In other embodiments, the coding sequence may encode more than one immunogen, such as one or more codon optimized tumor antigens. For example, a cancer vaccine utilizing the disclosed adenoviral vectors may encode a combination of self-antigens such as: HER2/neu, CEA, Hepcam, PSA, PSMA, Telomerase, gp100, Melan-A/MART-1, Muc-1, NY-ESO-1, Survivin, Stromelysin 3, Tyrosinase, MAGE3, CML68, CML66, OY-TES-1, SSX-2, SART-1, SART-2, SART-3, NY-CO-58, NY-BR-62, hKLP2, VEGF.

Development of an effective cancer vaccine requires the identification of a strategy that will elicit antigen-specific immunity in vaccinated patients and the generation of an immune response that will persist after active immunization has ended. The success of the strategy will depend on whether a measurable immune response directed against a target antigen will correlate with protection against cancer occurrence or relapse. The effector mechanisms of both cell-mediated immunity and humoral immunity have been show to kill tumor cells. However, data from experimental systems suggest that antigen-specific T cells represent the most powerful immunologic mechanism for the elimination of tumor cells. Recognition of tumor-specific antigens (e.g., TAAs) by effector T-cells is predicted to allow the TAA to function as a tumor-rejection antigen. Published studies suggest that stimulation of $CD8^+$ and $CD4^+$ helper T-cell responses are important for achieving optimal tumor clearance ((Greenberg, P. D. (1991) *Adv. Immunol.* 49: 281-355; Pardoll, D. M. et al. (1998) *Curr. Opin. Immunol.* 10: 588-94). Clinical response (i.e., efficacy) has been associated with increases in interferon γ-secreting cytotoxic T cells. The advent of assays, such as the ELISPOT assay used herein, to demonstrate the efficacy of the instant vaccine carriers, allows investigators to measure T-cell responses to vaccination regimens and thereby facilitates the development of cancer vaccines.

Cancer vaccines can be either prophylactic or therapeutic. The general assumption underlying the prophylactic use of cancer vaccines is that TAAs are extremely weak immunogens or functionally nonimmunogenic in tumor-bearing subjects. More specifically, in the field of cancer immunology, vaccines can be used as immunotherapy in patients afflicted with cancer. Accordingly, cancer vaccines can be designed to elicit an immune response that is that is directed against a TAA that is expressed by a pre-existing tumor or malignancy. Thus, in particular embodiments, therapeutic cancer vaccines are intended for use in tumor-bearing patients who have developed resistance to conventional regimens of treatment or who have a high probability of developing a recurrence following conventional treatment.

The high immunogenicity of adenoviruses, make adenoviral vectors particularly good candidates for use in the context of a vaccine carrier designed to break host tolerance to a self-antigen. The phenomenon of epitope or determinant spreading, which was first described in autoimmune diseases, has been associated with both MHC class I- and MHC class II-restricted responses and correlated to the development of HER-2/neu protein-specific T-cell immunity. Epitope spreading represents the generation of an immune response to a particular portion of an immunogenic protein followed by the natural spread of immunity to other antigenic determinants present on the same protein. For example, Disis et al. observed epitope spreading in 84% of patients afflicted with HER-2/neu overexpressing malignancies who were administered vaccines comprising peptides derived from potential T-helper epitopes of the HER-2 protein mixed with granulocyte-macrophage colony stimulating factor (*J. Clin. Oncol.* (2002) 20(11): 2624-2632). Importantly, epitope spreading was correlated with the generation of a HER-2/neu protein domain response and suggests that immunization effectively circumvented immunologic tolerance.

TAAs that are suitable for use in the disclosed adenoviral vectors and methods as a target for a cancer vaccine should possess a number of characteristics. For example, a target TAA must have a favorable expression profile, meaning that it should be preferentially expressed or overexpressed in the tumor or malignant tissue as compared with normal tissue. In addition, because TAAs that play a role in tumorigenesis are more likely to be retained during the different stages of cancer progression, a suitable target TAA should also preserved throughout tumor progression and metastases. Suitable target TAAs should also be expressed homogenously within the tumor. Third, suitable target TAAs must not be subject to absolute immunologic tolerance. More specifically, there should be some evidence that T cells which can both recognize and respond to the TAA of interest have not been entirely deleted from the host's T-cell repertoire (Berinstein, N. L., *J. Clin. Oncol.* 29(8): 2197 (2002).

Carcinoembryonic antigen (CEA) has many characteristics which make it an attractive TAA for use as a target antigen for an anticancer vaccine. It is a member of the Ig superfamily which is characterized by a favorable expression pattern. It is expressed in more than 50% of all human cancers and has been implicated in the tumorigenesis process, which suggests that its expression may be selected and conserved throughout cancer progression. In addition, it has been established that immunologic tolerance to CEA is not absolute. Published studies establish that human T cells can recognize, become activated to, and lyse cancer cells that express CEA (Berinstein, N. L., *J. Clin. Oncol.* 29(8): 2197 (2002). For example, the immunization of patients with recombinant vaccinia virus expressing CEA, combined with subsequent peptide-based in vitro stimulations, generated CD8+ MHC-restricted CTLs capable of lysing autologous tumors (Tsang, K. Y. et al. *J. Natl. Cancer Inst.*, (1995) 87:982-990). Alternatively, immunization of colorectal carcinoma patients after surgery with recombinant CEA was reported to induce weak antibody and cellular responses to recombinant CEA (Samanci, A., et al. (1998) *Cancer Immunol. Immunother.* 47: 131-142.) Further, the administration of anti-CEA anti-idiotypic antibody to patients diagnosed with colorectal cancer generated anti-CEA antibodies and idiotype-specific T-cell proliferation (Foon, L, A. et al. (1995) *J. Clin. Invest.*, 96: 334-342). The literature also indicates that tolerance to CEA in cancer patients can be overcome with several different vaccination approaches (i.e., vaccination with recombinant CEA or recombinant *orthopox* or avipox-CEA viruses, administration of anti-idiotype antibodies, pulsing dendritic cells with CEA agonist epitopes).

CEA is an oncofetal glycoprotein that is expressed in normal fetal colon and to a much lesser extent in normal colonic mucosa. It is also overexpressed in the vast majority of adenocarcinomas, particularly those of the colon, pancreas, breast, lung, rectum and stomach. Many colorectal cancers and some carcinomas produce high levels of CEA that are measurable in sera, which makes it one of the most widely used serological markers of malignancy, especially in patients with colorectal cancer.

A second TAA which provides a suitable immunogen for use in the compositions and methods of the invention is product of the HER2/erb-2 (also called neu) proto-oncogene. Like, CEA, HER2/neu has a favorable expression pattern and is not subject to absolute tolerance. More specifically, low levels of expression of the HER2/neu transcript, and the 185 kD polypeptide product, are detected in normal adult epithelial cells of various tissues, including the skin and breast, and tissues of the gastrointestinal, reproductive, and urinary tracts; higher levels of expression are detected in the corresponding fetal tissues during embryonic development (Press et al., *Oncogene* 5: 953-962 (1990). Several lines of evidence suggest a link between the amplification of HER-2 and neoplastic transformation in human breast, lung, prostate, ovarian, endometrial and colorectal tumors (Disis and Cheever, *Adv. Cancer Research* 71: 343-371 (1997). Generally speaking, overexpression of HER2/neu correlates with a poor prognosis and a higher relapse rate for cancer patients (Slamon et al., *Science* 244: 707-712 (1989). Thus, a vaccine specific for the HER-2/neu protein could have wide application and utility in the prevention of disease recurrence in many different human malignancies.

HER2/neu encodes a transmembrane glycoprotein possessing intrinsic tyrosine kinase activity and displaying extensive homology to the epidermal growth factor (EGF) receptor (Akiyama, T et al., (1986) Science 232: 1644-1646). One of the first clinical studies which utilized HER2 as target for cancer immunotherapy employed the HER-2-specific monoclonal antibody Herceptin for the treatment of breast cancer (Goldenberg M M (1999) *Clin. Ther.* 21: 309-318). This led to subsequent efforts which focused on the use of HER-2 as a target for the T-cell arm of the immune system to elicit effective antitumor responses, including the use of recombinant fusion proteins comprising HER-2 domains to activate autologous antigen presenting cells. Published reports establish that numerous cancer patients afflicted with neu-expressing mammary and ovarian cancers mount immune responses (e.g., produce antigen-specific antibody and T-cells) against the protein product of the HER2/neu oncogene.

Assembly of the recombinant adenoviral sequences, transgene and other vector elements into various intermediate plasmids and shuttle vectors, and the use of the plasmids and vectors to produce a recombinant viral particle are all achieved using conventional techniques as described in standard textbooks that are well known to those of skill in the art (Sambrook et al, Molecular Cloning: A Laboratory Manual, $2^{nd}$ Ed., Cold Spring Harbor Press, Cold Spring Harbor, N.Y. (1989). Such techniques include, but are not limited to conventional cDNA cloning techniques, use of overlapping oligonucleotide sequences derived from the adenoviral genome, homologous recombination, polymerase chain reaction, standard transfection techniques, plaquing of viruses in agar overlay and other related methodologies.

To assist in preparation of polynucleotides in prokaryotic cells, a plasmid version of the adenovirus vector is often prepared (adenovirus pre-plasmid). The adenovirus pre-plasmid contains an adenoviral portion and a plasmid portion. The adenoviral portion is essentially the same as the adenoviral portion contained in the adenoviral vectors of the invention (containing adenoviral sequences with nonfunctional or deleted E1 and optionally E3 regions) and an immunogen expression cassette, flanked by convenient restriction sites.

The plasmid portion of the adenovirus pre-plasmid often contains an antibiotic resistance marker under transcriptional control of a prokaryotic promoter so that expression of the antibiotic does not occur in eukaryotic cells. Ampicillin resistance genes, neomycin resistance genes and other pharmaceutically acceptable antibiotic resistance markers may be used. To aid in the high level production of the polynucleotide by fermentation in prokaryotic organisms, it is advantageous for the adenovirus pre-plasmid to contain a prokaryotic origin of replication and be of high copy number. A number of commercially available prokaryotic cloning vectors provide these benefits. It is desirable to remove non-essential DNA sequences. It is also desirable that the vectors not be able to replicate in eukaryotic cells. This minimizes the risk of integration of polynucleotide vaccine sequences into the recipients' genome. Tissue-specific promoters or enhancers may be used whenever it is desirable to limit expression of the polynucleotide to a particular tissue type.

Adenovirus pre-plasmids (plasmids comprising the genome of the replication-defective adenovirus with desired deletions and insertions) can be generated by homologous recombination using adenovirus backbones DNA and an appropriate shuttle vector (designed to target-in specific deletions and incorporate desired restriction sites into the resultant plasmid). Shuttle vectors of use in this process can be generated using general methods widely understood and appreciated in the art, e.g., PCR of the adenoviral terminal ends taking into account the desired deletions, and the sequential cloning of the respective segments into an appropriate cloning plasmid. The adenoviral pre-plasmid can then be digested and transfected into the complementing cell line via calcium phosphate co-precipitation or other suitable means. Virus replication and amplification then occurs, a phenomenon made evident by notable cytopathic effect. Infected cells and media are then harvested after viral replication is complete (generally, 7-10 days post-transfection).

Generally speaking, following the construction and assembly of the desired adenovirus pre-plasmids, adenovirus pre-plasmids are rescued into virus by transfecting an adenoviral E1-expressing human cell line. Complementation between the packaging cell line and the viral genes of the vector permits the adenovirus-transgene sequences in the vector to be replicated and packaged into virion capsids, resulting in the production of recombinant adenoviruses. The resulting viruses may be isolated and purified by any of a variety of methods known to those of skill in the art for use in the methods of the invention.

It will be readily apparent to those of skill in the art that when one or more selected deletions of chimpanzee adenoviral genes are introduced into a viral vector, the function of the deleted gene product can be supplied during the production process by sequences present in the production cell line. Thus, the function of the manipulated genes can be provided by a permanently transformed cell line that is characterized by some or all of the adenoviral functions which are required for packaging but which are not functional in the vector (e.g., any of E1A, E1B, E2A, E2B E4). Alternatively, the requisite adenoviral functions can be provided to a suitable packaging cell line by infecting or transiently transfecting a suitable cell with a construct comprising the requisite gene to provide the function.

Accordingly, the present invention also provides a method of producing chimpanzee adenoviral vectors in E1-expressing human cell lines. More specifically, the disclosed vectors can be propagated in an E1 complementing cell lines, including the known cell lines 293 and PER.C6™. Both these cell lines express the adenoviral E1 gene product. PER.C6™ is described in WO 97/00326, published Jan. 3, 1997, which is hereby incorporated by reference. It is a primary human retinoblast cell line transduced with an E1 gene segment that complements the production of replication deficient first generation adenoviruses, but is designed to prevent generation of replication competent adenovirus by homologous recombination. 293 cells are described in Graham et al (1977) *J. Gen. Viral* 36:59-72, which is also hereby incorporated by reference. One of skill in the art will recognize the term "first generation adenovirus" refers to a replication deficient adenovirus which has either a non-functional or deleted E1 region, and optionally a non-functional or deleted E3 region.

Batches of replication-defective adenoviral vectors that are intended for use as a vaccine composition in a clinical trial should be proven to be free of RCA (Fallaux, F. J. et al (1998) *Human Gene Therapy,* 9:1909-1917). In practice, this is a labor intensive process which requires establishing and utilizing an expensive screening program. One of skill in the art will acknowledge that a high frequency of RCA generation not only results in a high failure rate for the batches produced, but also severely limits scale-up efforts. Elimination of sequence homology between the nucleotide sequence of the vector and the adenoviral sequences present in the genome of the helper production/packaging cell line should eliminate the possibility of producing batches of vector that are contaminated with RCAs produced by homologous recombination.

Typically, recombinant replication-defective adenoviral vectors are propagated in cell lines that provide E1 gene products in trans. Supplementation of the essential E1 gene products in trans is very effective when the vectors are from the same or a very similar serotype. For example, it is well-known that E1-deleted (i.e. $\Delta$E1) group C serotype (Ad2 and Ad5) vectors, can be propagated in 293 or PER.C6 cells which contain and express the Ad5 E1 region. However, it has been observed that Ad5 E1 sequences present in the 293 and PER.C6 production cells may not always fully complement the replication of non-group C serotypes. Accordingly, E1-deleted serotypes outside of subgroup C, for example those from subgroups A, B, D, E, and F may replicate with a lower efficiency respect to the corresponding wt virus or may not replicate at all in 293 or PER.C6 cells. This may be due to the inability of the Ad5 (group C) E1 B 55K gene product to establish a functional interaction with the E4 orf6 gene product of the non-group C serotypes.

The decrease in replication efficiency in cells expressing Ad5 E1 is variable considering vectors of different subgroups. While $\Delta$E1 vectors deriving from subgroup D and E adenovirus can be rescued and propagated in 293 and Per.C6™ cells with variable efficiency, the propagation $\Delta$E1 vectors of subgroup B is completely impaired (Vogels R, et. al. (2003) Aug. Replication-deficient human adenovirus type 35 vectors for gene transfer and vaccination: efficient human cell infection and bypass of preexisting adenovirus immunity. *J. Virol.* 77 (15):8263-71).

Although the interaction between Ad5 E1b 55k and vector-expressing E4 orf6 protein is conserved within members of the same subgroup, it may be not sufficiently stable when E4 orf6 protein of a non-C serotype is expressed. This inefficient or unstable formation of E1B-55K/E4-orf6 complex lead to an absent of reduced propagation of the ΔE1 vector. Accordingly, it has been empirically determined that in order to successfully and efficiently rescue recombinant adenovirus of group B serotypes, a cell line expressing the E1 region of the serotype of interest may need to be generated. In cells expressing Ad5E1 like 293 or Per.C6™, the expression can be limited to E1b 55K protein. Alternatively, a suitable Ad5E1-expressing cell lines could be modified to express the entire Ad5 E4 region (or E4 orf6 only) in addition to Ad5E1. The generation of cell lines expressing both Ad5 E1 and orf6 are useful in complementing alternative adenovirus serotypes; see, e.g., Abrahamsen et al., 1997 *J. Virol.* 8946-8951. The incorporation of E4 (orf6) into Ad5 complementing cell lines, is known, as is the generation of serotype-specific cell lines providing a serotype-specific E1 gene product(s) in trans. Alternatively, the efficiency of non-group C vector propagation may be improved by modification of the viral backbone by substituting the native E4 region with Ad5 orf6. Similar results can be achieved by substituting the only the native orf6 with orf6 deriving from Ad5 or other subgroup C viruses (Ad1, Ad2, Ad6). U.S. Pat. No. 5,849,561 discloses complementation of an E1-deleted non-group C adenovirus vector in an Ad5-E1 complementing cell line which also expresses portions of the Ad5-E4 gene.

U.S. Pat. No. 6,127,175, issued to Vigne, et al., discloses a stably transfected mammalian cell line which expresses a portion of the E4 region of adenovirus, preferably orf6/orf6/7. Such a cell line is useful for complementation of recombinant Ad genomes deficient in the E4 region.

Compositions, including vaccine compositions, comprising the disclosed adenoviral vectors are an important aspect of the present invention. These compositions can be administered to mammalian hosts, preferably human hosts, in either a prophylactic or therapeutic setting. Potential hosts/vaccinees include but are not limited to primates and especially humans and non-human primates, and include any non-human mammal of commercial or domestic veterinary importance. Compositions comprising recombinant chimpanzee adenoviral vectors may be administered alone or in combination with other viral- or non-viral-based DNA/protein vaccines. They also may be administered as part of a broader treatment regimen.

In a particular embodiment of the invention, the disclosed vectors may be used in an immunization protocol designed to break host tolerance to a self-antigen or a tumor-associated antigen. The identification of a number of TAA has enabled the development of active vaccination approaches for the therapy of cancer. Both cell surface antigens and intracellular antigens that are processed and presented provide useful targets. Generally speaking, the disclosed method of breaking host tolerance to a self-antigen comprises: (a) stimulating an antigen-specific response to a self-antigen by administering a first vaccine composition comprising a first ChAd vector or a plasmid vector carrying a nucleotide sequence encoding the self-antigen against which an antigen-specific immune response is desired, and (b) sustaining and expanding the immune response of (a) by administering a second vaccine composition comprising a recombinant ChAd vector of a different serotype containing at least a functional deletion of its genomic E1 gene, and in the site of the E1 gene, a sequence comprising a promoter capable of directing the expression of DNA encoding the same self-antigen delivered in the priming step, whereby the host mounts an immune response which has the effect of breaking tolerance to the self-antigen.

Accordingly, a skilled artisan can utilize this disclosure to design several different immunization protocols that may be suitable for use to break host tolerance. For example, it may be possible to utilize a protocol in which the first, or priming immunization comprises plasmid DNA which encodes a particular self-antigen, such as a TAA, and any subsequent immunizations comprise a ChAd vector. Plasmid DNA sequences comprising nucleotide sequences that encode self-antigens, may be delivered intramuscularly, with or without electrostimulation, in one or more injections. For example, an immunization protocol based on multiple (e.g., 3 or 4 or 5) intramuscular injections of plasmid DNA encoding a TAA via electroporation followed by one or more intramuscular injections of a ChAd vector comprising a transgene encoding the same TAA is encompassed by the general method disclosed and claimed herein.

Alternatively, a suitable protocol to break tolerance could involve one or more priming immunizations with a ChAd or hAd vector comprising a transgene encoding a self antigen, followed by one or more boosting immunizations with either the same, or a different ChAd vector that is know to be non cross-reactive with the vector used for the priming immunization(s). For example, an immunization protocol using ChAd3 for priming and ChAd6 for boosting, or ChAd3 for priming followed by ChAd6 and ChAd9 for boosting could be used to break host tolerance. In particular embodiments, the invention contemplates the use of self-antigens comprising at least one tumor associated antigen selected from the group consisting of: HER2/neu, CEA, EpCAM, PSA, PSMA, Telomerase, gp100, Melan-A/MART-1, Muc-1, NY-ESO-1, Survivin, Stromelysin 3, Tyrosinase, MAGE3, CML68, CML66, OY-TES-1, SSX-2, SART-1, SART-2, SART-3, NY-CO-58, NY-BR-62, hKLP2, VEGF. In a particular embodiment, the invention provides a method for inducing an immune response (e.g., humoral or cell-mediated) to a tumor-associated antigen which is specific for a selected malignancy by delivering a recombinant chimpanzee adenovirus encoding the TAA to a mammal afflicted with cancer. In a preferred embodiment of this aspect of the invention the elicited immune response constitutes an immune response characterized by the production of antigen-specific CD4+ and CD8+ T cells.

The immunogenic compositions of the invention can be administered to mammalian hosts, preferably human hosts, in either a prophylactic or therapeutic setting. Potential hosts/vaccinees include but are not limited to primates and especially humans and non-human primates, and include any non-human mammal of commercial or domestic veterinary importance. Compositions comprising recombinant chimpanzee adenoviral vectors may be administered alone or in combination with other viral- or non-viral-based DNA/protein vaccines. They also may be administered as part of a broader treatment regimen. Suitable compositions, for use in the methods of the invention may comprise the recombinant viral vectors of the invention in combination with physiologically acceptable components, such as buffer, normal saline or phosphate buffered saline, sucrose, other salts and polysorbate. It does not cause tissue irritation upon intramuscular injection. It is preferably frozen until use. Optionally, a vaccine composition of the invention may be formulated to contain other components, such as but not limited to, an adjuvant, a stabilizer, a pH adjusting agent, or a preservative. Such components are well known to those of skill in the art.

It is envisioned that the recombinant chimpanzee adenoviruses of the invention will be administered to human or veterinary hosts in an "effective amount," that is an amount of recombinant virus which is effective in a chosen route of administration to transduce host cells and provide sufficient levels of expression of the transgene to invoke an immune response which confers a therapeutic benefit or protective immunity to the recipient/vaccine.

The amount of viral particles in the vaccine composition to be introduced into a vaccine recipient will depend on the strength of the transcriptional and translational promoters used and on the immunogenicity of the expressed gene product. In general, an immunologically or prophylactically effective dose of $1 \times 10^7$ to $1 \times 10^{12}$ particles (i.e., $1 \times 10^7$, $2 \times 10^7$, $3 \times 10^7$, $5 \times 10^7$, $1 \times 10^8$, $2 \times 10^8$, $3 \times 10^8$, $5 \times 10^8$ or $1 \times 10^9$, $2 \times 10^9$, $3 \times 10^9$, $5 \times 10^9$) and preferably about $1 \times 10^{10}$ to $1 \times 10^{11}$ particles is administered directly into muscle tissue. Subcutaneous injection, intradermal introduction, impression through the skin, and other modes of administration such as intraperitoneal, intravenous, or inhalation delivery are also contemplated.

The recombinant chimpanzee adenoviral vectors of the present invention may be administered alone, as part of a mixed modality prime/boost vaccination regimen or in a vaccination regimen based on combination of multiple injections of different vector serotypes. Typically, a priming dose(s) comprising at least one immunogen is administered to a mammalian host in need of an effective immune response to a particular pathogen or self-antigen. This dose effectively primes the immune response so that, upon subsequent identification of the antigen(s), the host is capable of immediately mounting an enhanced or boosted immune response to the immunogen. A mixed modality vaccination scheme which utilized alternative formulations for the priming and boosting can result in an enhanced immune response. Prime-boost administrations typically involve priming the subject (by viral vector, plasmid, protein, etc.) at least one time, allowing a predetermined length of time to pass, and then boosting (by viral vector, plasmid, protein, etc.). Multiple immunizations, typically 1-4, are usually employed, although more may be used. The length of time between priming and boost may typically vary from about four months to a year, albeit other time frames may be used as one of ordinary skill in the art will appreciate. Multiple injection of each vector can be administered within approximately a 2 weeks time frame, before neutralizing immunity becomes evident.

In some embodiments of this invention, a vaccine is given more than one administration of adenovirus vaccine vector, and it may be given in a regiment accompanied by the administration of a plasmid vaccine. Suitable plasmid vaccines for use in combination with the vectors disclosed herein comprise a plasmid encoding at least one immunogen against which a primed or boosted immune response is desired, in combination with a heterologous promoter, which is capable of directing expression of the nucleic acid sequences encoding the immunogen(s), operably linked to the immunogen coding sequence, and a transcription terminator sequence.

For example, a dosing regimen which utilizes multiple injection of different serotypes of recombinant replication-defective chimpanzee adenoviral vectors can be used. Alternatively, an individual may be given a first dose (i.e., a priming dose) of a plasmid vaccine, and a second dose (i.e., a boosting dose) which comprises a replication-defective recombinant chimpanzee adenoviral vector which comprises a coding sequence for the same immunogen that was delivered in the plasmid vaccine. Alternatively, the individual may be given a first dose of a human adenovirus vaccine vector encoding at least one immunogen, followed by a second dose comprising a replication-defective recombinant chimpanzee adenoviral vector disclosed herein, which comprises a coding sequence for the same immunogen that was delivered in the priming dose. In a second alternative embodiment a vaccine composition comprising a vector of the invention may be administered first, followed by the administration of a plasmid vaccine. In any of these embodiments, an individual may be given multiple doses of the same immunogen in either viral vector or plasmid form. There may be a predetermined minimum amount of time separating the administrations.

In addition to a single protein or antigen of interest being delivered by the recombinant, replication-defective chimpanzee adenovirus vectors of the present invention, two or more proteins or antigens can be delivered either via separate vehicles or delivered via the same vehicle. Multiple genes/functional equivalents may be ligated into a proper shuttle plasmid for generation of a adenovirus pre-plasmid comprising multiple open reading frames. Open reading frames for the multiple genes/functional equivalents can be operatively linked to distinct promoters and transcription termination sequences.

As shown herein, suitable immunization regimens can employ different adenoviral serotypes. One example of such a protocol would be a priming dose(s) comprising a recombinant adenoviral vector of a first serotype, for example a ChAd3 or ChAd6 followed by a boosting close comprising a recombinant chimpanzee adenoviral vector of a second serotype. In an alternative embodiment, the priming dose can comprise a mixture of separate adenoviral vehicles each comprising a gene encoding for a different protein/antigen. In such a case, the boosting dose would also comprise a mixture of vectors each comprising a gene encoding a separate protein/antigen, provided that the boosting dose(s) administers recombinant viral vectors comprising genetic material encoding for the same or similar set of antigens that were delivered in the priming dose(s). These multiple gene/vector administration modalities can further be combined. It is further within the scope of the present invention to embark on combined modality regimes which include multiple but distinct components from a specific antigen.

Use of recombinant vectors derived from chimpanzee adenoviruses that are not neutralized by preexisting immunity directed against the viral elements of human vector offers an alternative to the use of human Ad vectors as vaccine carriers. Because adenoviruses are highly immunogenicity, adenoviral vectors are particularly good candidates for use in the context of a vaccine carrier designed to break host tolerance to a self-antigen. Furthermore, the ability to propagate the chimp viruses in human cells, particularly in the Per.C6™ cell line, with an efficiency comparable to human viruses, offers considerable advantages both from a regulatory point of view and for the large scale production of therapeutics or vaccines. Accordingly, the instant invention provides a collection of chimpanzee adenoviral sequences, vectors and plasmids that allow the preparation of recombinant virus which may be used, alone or in combination, as a vaccine carrier for genetic vaccination.

All publications mentioned herein are incorporated by reference for the purpose of describing and disclosing methodologies and materials that might be used in connection with the present invention. Nothing herein is to be construed as an admission that the invention is not entitled to antedate such disclosure by virtue of prior invention.

Having described preferred embodiments of the invention with reference to the accompanying drawings, it is to be understood that the invention is not limited to those precise embodiments, and that various changes and modifications may be effected therein by one skilled in the art without departing from the scope or spirit of the invention as defined in the appended claims.

The following examples illustrate, but do not limit the invention.

EXAMPLE 1

Isolation, Cloning, Sequencing and Characterization of ChAds Chimpanzee Adenovirus Isolation Stool specimens were collected in viral transport medium (VTM; Microtest M4-R Multi-Microbe Transport Medium, Remel Inc.) then frozen or frozen directly at −70° C. at NIRC (New Iberia Research Center 4401 W. Admiral Doyle Drive New Iberia, La. 70560). The specimens were kept frozen at <−70° C. until they were processed for inoculation into cell cultures. At that time, the specimens were thawed and then vortexed in excess of chilled viral transport medium. After the specimens had dissociated into suspensions, they were centrifuged for 10 min at 1500-1800 rpm. The supernatants were filtered through 0.8 and 0.2 μm syringe filters in series and then the filtered material was inoculated into cell cultures (200-250 μL into shell vials and 250-300 μL into tube cultures). Each processed specimen was inoculated into tube cultures and shell vial cultures seeded with 293 cells or A549 cells.

Control (positive and negative) cultures were prepared each time a set of samples was inoculated. Once all of the shell vials in a set-up had been inoculated, they were centrifuged at room temperature for 60±10 min at 2000 rpm (900× g). The vials were removed from the centrifuge immediately after the rotor stopped spinning to prevent heat damage in the cultures. After centrifugation, the inocula were aspirated from the shell vials, using a fresh sterile Pasteur pipette in each vial to prevent cross-contamination. The cultures were washed three times using 1.0-mL fresh culture medium for each wash. Fresh medium (1.0 mL) was pipetted into each vial after the third wash and the shell vials were placed in an incubator at 35-37° C. for three to four days (approx. 96 hr).

At the end of the culture period, the supernatants were aspirated from the cultures and the cell layer in each vial was washed twice with Immunofluorescence Assay (IFA) Buffer using approximately 1.0 mL buffer with each wash. The cells were fixed by adding 1.0 mL refrigerated acetone to each vial (10 min at 2-8° C. Acetone-cleaned slides were labeled with the specimen identification number(s) associated with the shell vial coverslips. The shell vial coverslips were processed for fluorescence labeling of Adenovirus-infected cells using a primary mouse anti-adenovirus antibody [MAB8052, Chemicon]. The slides are evaluated with the aid of a fluorescence microscope. Each preparation was scanned using the 10× objective noting the extent of immunofluorescence coverage across the well (1+ to 4+). The presence or absence of specific immunofluorescence was confirmed using the 40× objective. Tube cultures were inoculated in the same sequence as described for the shell vials (e.g., negative control first, followed by clinical specimens and positive controls). The inocula were allowed to adsorb for 60-120 min at 36-38° C. After the adsorption period, the specimens/controls were aspirated from the tubes and replaced by fresh culture medium.

Three to four days post-inoculation, and once a week thereafter, the media was aspirated from the culture tubes and replaced with 1.5 mL fresh media. Culture tubes were visually monitored for CPE at least every other day for at least 21 days after inoculation. Cultures inoculated with chimp specimens were compared against the controls and rated by observing the CPE extent. Cultures showing no CPE were passed to fresh tube cultures after 14 days; culture tubes that were negative for CPE after 21 days were considered negative. Culture tubes with 3-4+ CPE were vortexed for 10 seconds. The cells were scraped from the wall of the tube using a sterile 1.0 mL serological pipette and suspended in the culture supernatant. After labeling a 5 mL snap cap tube with the specimen identification number and date and stored at −70° C. 500 μL of the cell suspension was transferred from the culture tube into the snap cap tube and stored for up to one day at 2-8° C. until it was processed using an indirect immunofluorescent antibody technique to detect adenovirus (equivalent to procedure for staining shell vials).

Chimpanzee Adenovirus Amplification

Wild type chimp adenoviruses CV32, CV33, CV23 and CV68 purchased from the ATCC (ATCC Accession Numbers: CV32, VR-592; CV-33, VR-593;) or from Esoterix Inc. Austin, Tex. and original isolates were propagated as follows by using the human E1-expressing cell line PER.C6™ or 293. Briefly, cells were cultivated in Dulbecco's Modified Eagles Medium (DMEM; GibcoBRL, Life Technologies) supplemented with 10% Fetal Bovine Serum (FBS GibcoBRL, life Technologies), 1% Penicillin-Streptomycin, 2 mM Glutamine and 10 mM $MgCl_2$(Per.C6™). Adenovirus infection was carried out in DMEM supplemented with 5% Horse Serum (GibcoBRL, Life Technologies). Infected cells and medium were collected when 100% of the cells exhibited virus-induced cytopathic effect (CPE) and lysed by three cycles of freezing and thawing.

All wild type chimp adenoviral (CV) stocks were cloned by infecting 293 cells seeded in 96-well plates, after the first passage of amplification. The virus cloning was performed by limiting dilution of the cell lysate obtained at the first passage of the virus amplification. Five isolated clones were picked up and serially propagated. After 3-4 serial passages of amplification, a large-scale preparation of adenovirus was performed on cells planted on 5 two-layer cell-factories (NUNC) (200 millions of cells/cell factory). Purified viral particles were obtained from cell lysate by two ultra-centrifugation steps on cesium chloride density gradients.

Sequencing of Viral Genomic DNA

Genomic DNA was isolated from $3 \times 10^{12}$ pp of purified virus preparation by digestion with Proteinase K (0.5 mg/ml) in 1% SDS-TEN (2 hrs at 55° C.). After a Phenol-Chloroform extraction and Ethanol precipitation, the genomic DNA was resuspended in water and submitted for genomic sequencing.

For full length Ad genome sequencing, the purified viral DNA was nebulized to produce randomly sheared fragments. The DNA fragments were blunt-ended with the klenow fragment of *E. coli* DNA polymerase and polynucleotide kinase. The blunt end fragment were run on a low melting point agarose gel to purify the fragments in the size range of 1-3 kb and cloned into the SmaI site of pUC19 vector to create a shotgun library. The ligations were used to transform competent XL1-Blue MRF'. Positive colonies were identified by white/blue screening on LB agar containing X-gal and IPTG. Three to four 96-well block of plasmid DNA were isolated from the library and sequenced with pUC forward and reverse primers. All sequencing reads were screened for quality and vector sequence using the Phred-Phrap software package. The reads that passed the screening were assembled into contigs. Primers were designed to directly sequence the adenoviral DNA for closing the gaps and determine the DNA sequence of both ends.

Complete viral genome sequencing was obtained for selected viruses including ChAd3 (SEQ ID NO: 1), ChAd6 (SEQ ID NO: 2), CV32 (SEQ ID NO: 3), CV33 (SEQ ID NO: 4), and CV23 (SEQ ID NO: 5). Table 1 provides data summarizing the percentage of identity between the nucleotide sequences of ChAd3, ChAd6, Pan5 (CV23), Pan6 (CV32), Pan7 (CV33), C1 and C68 adenoviral genomes. Alignments were calculated using the ALIGN program as part of the FASTA package version 2 (William R. Penson, University of Virginia; Myers & Miller, CABIOS 1989, 4:11-17).

TABLE 1

Percentage of Nucleotide Sequence Identity
Between Chimpanzee Adenovirus Genomes

| | ChAd3 | ChAd6 | Pan5 | Pan6 | Pan7 | C1 | C68 |
|---|---|---|---|---|---|---|---|
| ChAd3 | 100 | 68.1 | 68.5 | 68.2 | 68.3 | 64.2 | 68.0 |
| ChAd6 | | 100 | 95.5 | 94.5 | 95.5 | 73.6 | 91.4 |
| Pan5 | | | 100 | 94.9 | 96.7 | 73.9 | 92.7 |
| Pan6 | | | | 100 | 95.1 | 73.6 | 91.3 |
| Pan7 | | | | | 100 | 73.8 | 93.0 |
| C1 | | | | | | 100 | 74.3 |
| C68 | | | | | | | 100 |

To characterize the new adenoviral isolates (e.g., ChAd20, ChAd4, ChAd5, ChAd7, ChAd8, ChAd9, ChAd10, ChAd11, ChAd16, ChAd17, ChAd19, ChAd22, ChAd24, ChAd26, ChAd30, ChAd31, ChAd37, ChAd38, ChAd44, ChAd63 and ChAd82) the nucleotide sequence of the hexon and fiber genes were also determined by primer walking. Fiber gene: SEQ ID NOS: 6-15: (SEQ ID NO: 6, ChAd20); (SEQ ID NO: 7, ChAd4); SEQ ID NO: 8, ChAd5); SEQ ID NO: 9, ChAd7); SEQ ID NO: 10, ChAd9); SEQ ID NO: 11, ChAd10); SEQ ID NO: 12, ChAd11); SEQ ID NO: 13, ChAd16) SEQ ID NO: 14, ChAd17), SEQ ID NO: 15, ChAd19), and (SEQ ID NO: 58, ChAd8), (SEQ ID NO: 60, ChAd22), (SEQ ID NO: 62, ChAd24), (SEQ ID NO: 64, ChAd26), (SEQ ID NO: 66, ChAd30), (SEQ ID NO 68, ChAd31), (SEQ ID NO: 70, ChAd37), (SEQ ID NO: 72, ChAd38), (SEQ ID NO: 74, ChAd44), (SEQ ID NO: 76, ChAd63) and (SEQ ID NO: 78, ChAd82). FIGS. 20A-20G provide a comparison of the amino acid sequences of the fiber proteins of the ChAd isolates disclosed and claimed herein.

The hexon gene sequences are set forth in SEQ ID NOS: 16-25: (SEQ ID NO: 16, ChAd20); SEQ ID NO: 17, ChAd4); SEQ ID NO: 18, ChAd5); SEQ ID NO: 19, ChAd7); SEQ ID NO: 20, ChAd9); SEQ ID NO: 21, ChAd10); SEQ ID NO: 22, ChAd11); SEQ ID NO: 2.3, ChAd16); SEQ ID NO: 24, ChAd17) SEQ ID NO: 25, ChAd19), (SEQ ID NO: 97, ChAd8), (SEQ ID NO: 99, ChAd22), (SEQ ID NO:101, ChAd24), (SEQ ID NO: 103, ChAd26), (SEQ ID NO: 105, ChAd30), (SEQ ID NO: 107, ChAd31), (SEQ ID NO: 109, ChAd37), (SEQ ID NO: 111, ChAd38), (SEQ ID NO: 113, ChAd44), (SEQ ID NO: 115, ChAd63) and (SEQ ID NO: 117, ChAd82). FIGS. 31A-31J provide a comparison of the amino acid sequences of the hexon proteins of the ChAd isolates disclosed and claimed herein.

Chimpanzee Adenovirus Classification

Classification of the different chimp adenoviral strains follows the already proposed classification of human adenovirus serotypes into 6 subgroups (Horowitz, M S (1990) Adenoviridae and their replication. In Virology B. N. Fields and D. M. Knipe, eds (Raven Press, New York) pp. 1679-1740) and it was obtained by amino acid and nucleotide sequence alignment by using Align X program (Informax, Inc).

An initial classification of the new isolates was obtained by looking at the restriction pattern of the viral genome with different restriction endonucleases and by sequence analysis of the hypervariable region 7 (HVR7) of the hexon gene. To this end two primers were designed on the highly conserved regions flanking HVR7: TGTCCTACCARCTCTTGCTTGA (SEQ ID NO. 45) and GTGGAARGGCACGTAGCG (SEQ ID NO. 46). The HVR7 was amplified by PCR using purified viral DNA or crude 293 lysate as template and then sequenced. Based on HVR7 sequence analysis we classified the new isolated viruses into the subgroups (A-F) proposed for human Ad viruses (Horowitz, M S (1990) Adenoviridae and their replication. In Virology B. N. Fields and D. M. Knipe, eds (raven Press, New York) pp. 1679-1740).

Figure 35:
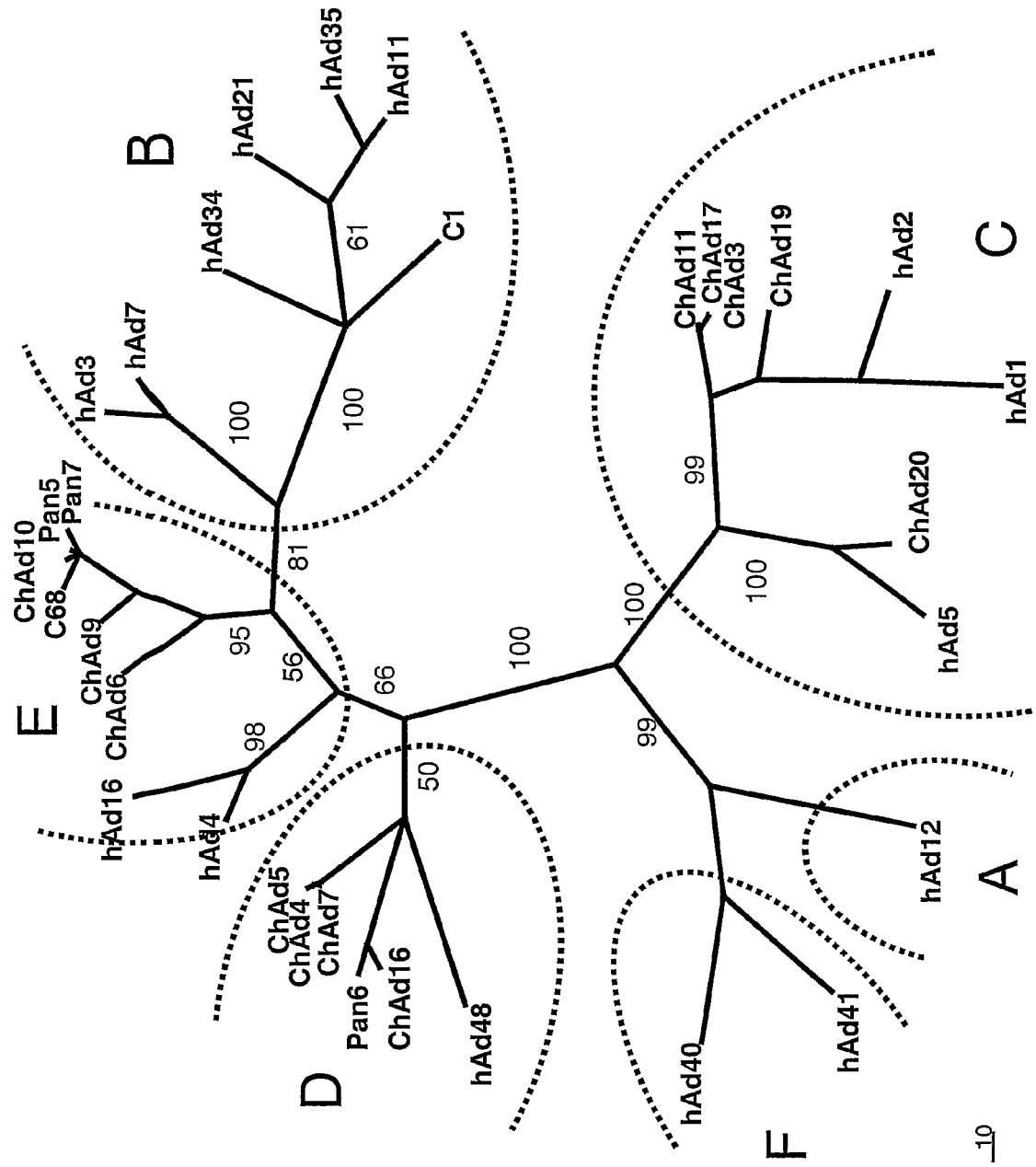
FIG. 35 provides a phylogenetic tree of human and chimpanzee adenoviruses of deduced from a multiple sequence alignment of full-length hexon peptide sequences using PAUPSEARCH (Wisconsin Package Version 10.3, Accelrys Inc.) and visualized and manipulated with TREEVIEW.

The phylogenetic tree presented in FIG. 35 was obtained by alignment of human and chimp adenovirus hexon amino acid sequences. The results are consistent with the initial classification based on nucleotide sequence alignment limited to hexon HVR7 by using Align X program (Informax, Inc). The tree was deduced from a multiple sequence alignment of full-length hexon peptide sequences using a PAUPSEARCH (Wisconsin Package Version 10.3, Accelrys Inc.) and visualized and manipulated with TREEVIEW. Bootstrap confidence analysis was performed using the PAUPSEARCH program as implemented in the Wisconsin Package. For each of the alignments the program was run on 1000 replicates using "Heuristic Search" as search criterion and Maximum Parsimony as the optimality criterion and confidence values reported were taken from a 50% majority-rule consensus.

EXAMPLE 2

Figure 2:
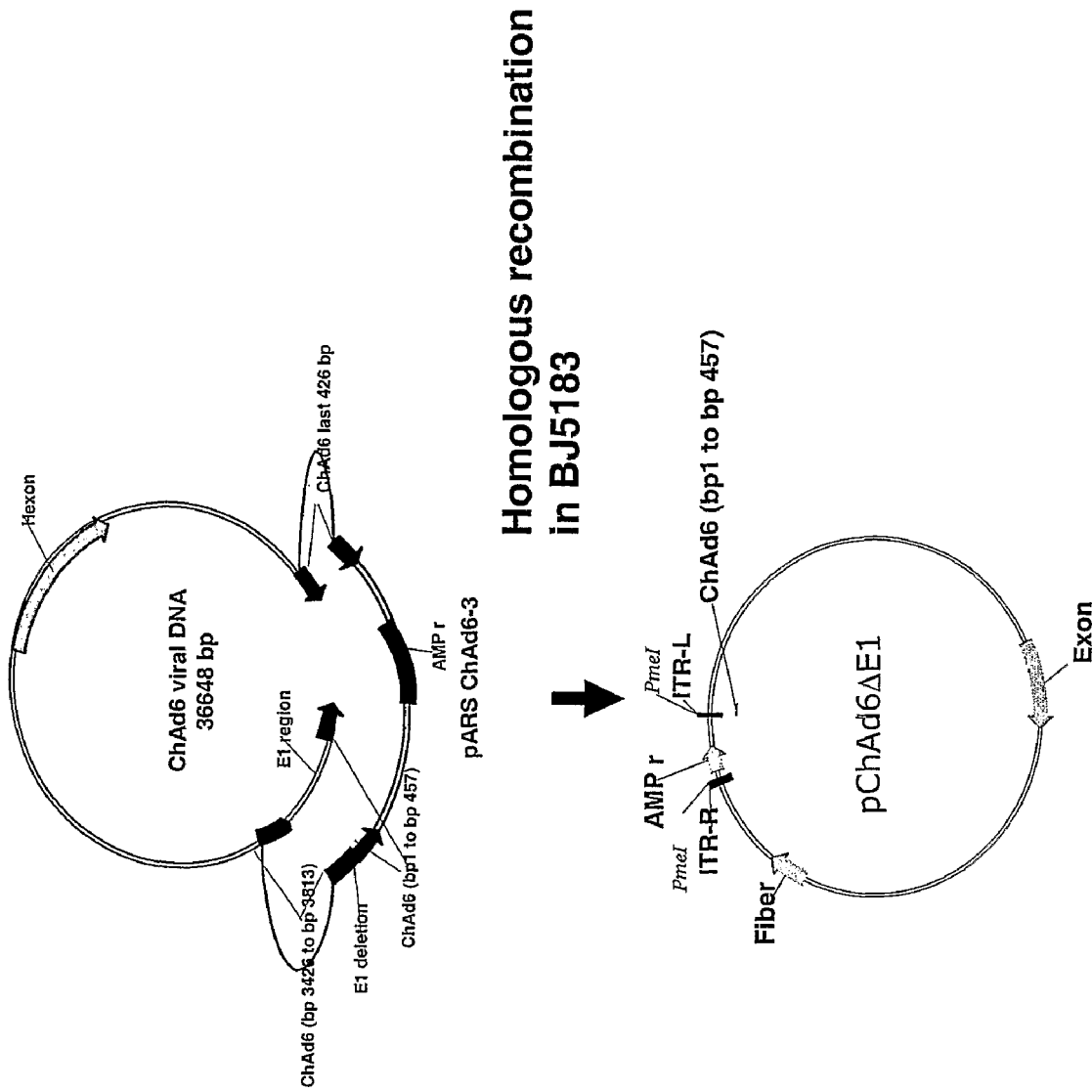
FIG. 2 is a schematic drawing which illustrates the cloning strategy used to clone the ChAd6 viral genome by homologous recombination in E. coli strain BJ5183.

ChAd Shuttle Vector and Expression Vector Construction and Rescue Vector Construction and Rescue Genomic viral DNA was cloned into a standard plasmid vector by homologous recombination with an appropriate shuttle vector containing viral DNA sequences derived from both left and right end of viral genome (FIG. 2). As described more fully below, the sequence homology observed between viruses classified in the same serotype subgroup was exploited to develop group-specific shuttle vectors. Genomic viral DNA of Chimp adenovirus classified into subgroup D and E resulted to be sufficiently homologous to allow the construction of a common shuttle vector in order to clone viruses belonging to both subgroups.

Construction of a Subgroup D/E Shuttle Vector

The ChAd6 viral genome was fully sequenced (SEQ ID NO: 2) and the information obtained was used to construct a shuttle vector to facilitate cloning by homologous recombination of subgroup D and E chimpanzee adenovirus.

Construction of the ChAd6 shuttle vector, referred to herein as pARS ChAd6-3 is described in FIG. 1. FIG. 32 provides a list of the oligonucleotide sequences (SEQ ID NOS: 26-40 and SEQ ID NOS: 45-46) used in the cloning experiments described herein. Briefly, 457 bp deriving from the left end of ChAd6 DNA were amplified by PCR with the oligonucleotides 5'-ATGGAATTCGTTTAAACCATCAT-CAATAATATACCTC-3 (SEQ ID NO: 27) and 5'-CGCTG-GCACTCAAGAGTGGCCTC-3' (SEQ ID NO: 28) digested with EcoRI and SnaBI and cloned into pNEBAd35-2 cut EcoRI-SnaBI, generating pNEBChAd6-LI. The right ChAd6 ITR (bp 36222 to by 36648) was amplified by PCR using the oligonucleotides: 5'-ATGAAGCTTGTTTAAACCCAT CATCAATAATATACCT-3'(SEQ ID NO: 29) and 5'-ATCTA- GACAGCGTCCATAGCTTACCG-3'(SEQ ID NO: 30) digested with restriction enzymes HindIII and XbaI and cloned into pNEBChAd6-LI HindIII-XbaI digested thus generating pNEBChAd6-RLI. Finally, the DNA fragment corresponding to nucleotides 3426-3813 of the ChAd6 genomic DNA sequence was amplified with the oligonucleotides: 5' ATGCTACGTAGCGATCGCGTGAGTAGT- GTTTGGGGGTGGGTGGG-3' (SEQ ID NO: 31) and 5'-TAGGCGCGCCGCTTCTCCTCGTTCAGGCTGGCG- 3' (SEQ ID NO: 32), digested with SnaBI and AscI then ligated with SnaBI-AscI digested pNEBChAd6-RLI thus generating pNEBChAd6-RLIdE1.

To improve the efficiency of recombination and plasmid propagation in DH5a E. coli strain, the 1306 bp fragment containing both left and right ITRs of ChAd6 as well as pIX gene fragment was excised by PmeI digestion from pNEB-ChAd6-RLIdE1 and transferred to a different plasmid vector obtained by PCR amplification with the olinucleotides 5'-GATCTAGTTAGTTTAAACGAATTCG- GATCTGCGACGCG-3' (SEQ ID NO: 33) and 5' TTCGAT-CATGTTTAAACGAAATTAAGAATTCGGATCC-3' (SEQ ID NO: 34) from pMRKAd5SEAP. This final ligation step generated the ChAd6 shuttle vector pARSChAd6-3.

Construction of a Subgroup C Shuttle Vector

The ChAd3 viral genome was fully sequenced (SEQ ID NO: 1) and the information obtained was used to construct a shuttle vector to facilitate cloning by homologous recombination of subgroup C chimpanzee adenovirus.

Briefly, the shuttle vector used to clone subgroup C chimp adenovirus, referred to herein as pChAd3EGFP was constructed as follows: a ChAd3 DNA fragment (nt 3542-4105) containing pIX coding region was amplified by PCR with the oligonucleotides 5'-TATTCTGCGATCGCTGAGGTGGGT- GAGTGGGCG-3' (SEQ ID NO: 35) and 5'-TAGGCGCGC- CCTTAAACGGCATTTGTGGGAG-3' (SEQ ID NO: 36) digested with SgfI-AscI then cloned into pARSCV32-3 digested with SgfI-AscI, generating pARS-ChAd3D. ChAd3 right end (nt 37320-37441) was amplified by PCR with oligonucleotides 5'-CGTCTAGAAGACCCGAGTCTTAC- CAGT-3' (SEQ ID NO; 37) and 5'-CGGGATCCGTT- TAAACCATCATCAATAATATACCTTATT-3' (SEQ ID NO: 38) digested with XbaI and BamHI then ligated to pARS-ChAd3D restricted with XbaI and BamHI, generating pARS-ChAd3RD. ChAd3 viral DNA left end (nt 1-460) was amplified by PCR with oligonucleotides 5'-ATGGAATTCGTTTAAACCATCAT- CAATAATATACCTT-3' (SEQ ID NO: 39) and 5'-AT-GACGCGATCGCTGATATC- CTATAATAATAAAACGCAGACTTTG-3', (SEQ ID NO: 40) digested with EcoRI and SgfI then cloned pARS-ChAd3RD digested with EcoRI and SgfI, thus generating pARS-ChAd3RLD. The viral DNA cassette was also designed to contain restriction enzyme sites (PmeI) located at the end of both ITR's so that digestion will release viral DNA from plasmid DNA.

Construction of a Subgroup B Shuttle Vector

The construction of subgroup B shuttle followed the already described strategy for subgroup C and D/E shuttle constructions. In brief, pARS-ChAd3RLD was modified by substituting the left end, the pIX region, the right end with the corresponding fragments of ChAd30. In addition the E4 region of ChAd30 was substituted with Ad5 E4orf6 that was cloned under the ChAd30 E4 promoter control. The shuttle plasmid was denominated pChAd30 EGFP shuttle vector.

Construction of ΔE1 Chimp Adenoviral Vectors

Figure 3:
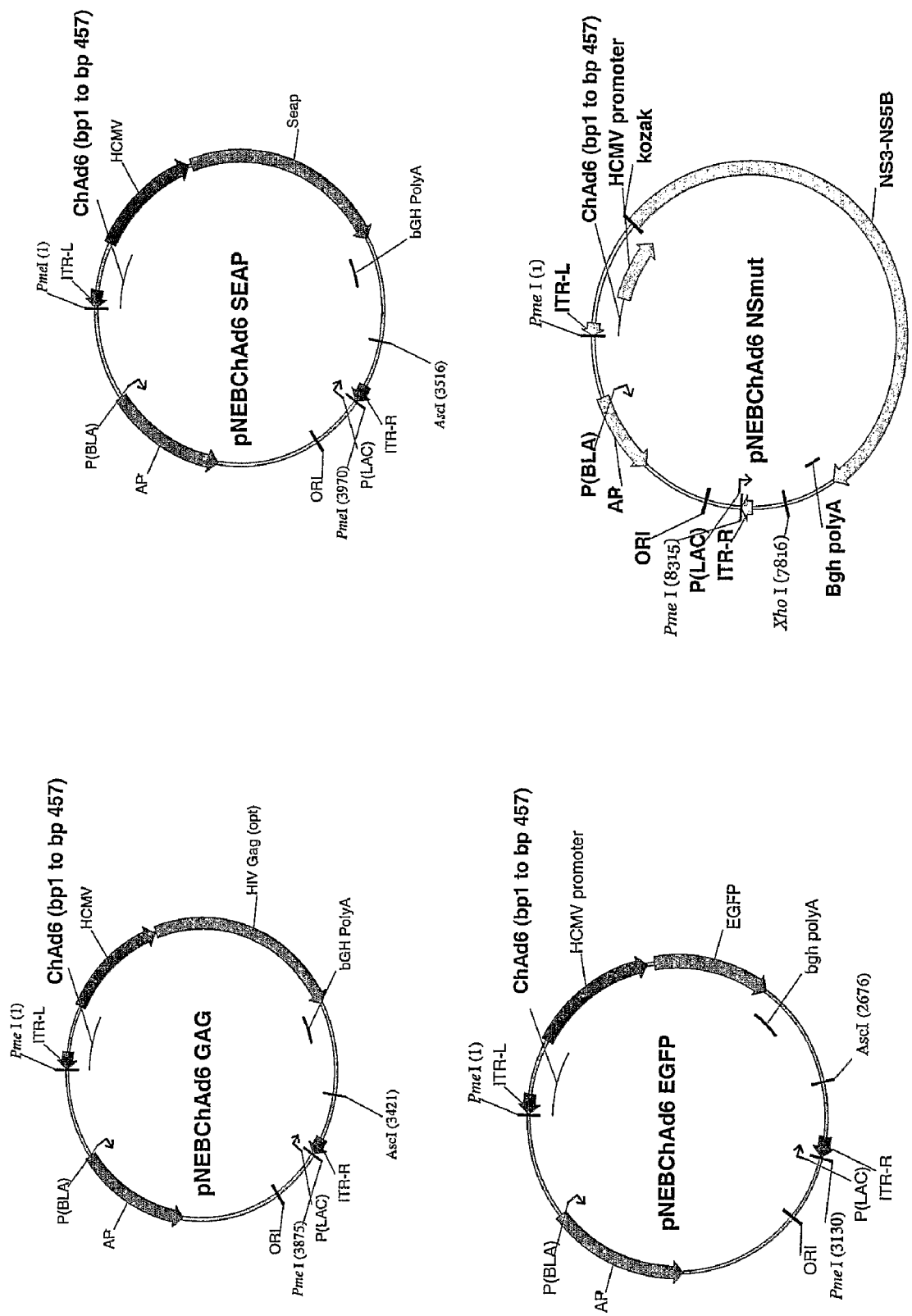
FIG. 3 is a schematic drawing illustrating the elements of various ChAd6 shuttle plasmids including: pARS ChAd6-3 GAG; pARS ChAd6-3 SEAP; pARS ChAd6-3 EGFP; and pARS ChAd6-3 NS MUT.

Subgroup B: Subgroup B chimp adenovirus vectors were constructed by homologous recombination in E. coli strain BJ5183. BJ5183 cells were co-transformed with pChAd30EGFP shuttle vector digested with BstEII and Bst1107I and ChAd8 and ChAd30, purified viral DNA. Homologous recombination between pIX genes, right ITR DNA sequences present at the ends of linearized pChAd30EGFP shuttle and viral genomic DNA allowed its insertion in the plasmid vector, deleting at the same time the E1 region that was substituted by EGFP expression cassette. Expression cassettes based on human cytomegalovirus (HCMV) promoter and bovine growth hormone polyadenylation signal (Bgh polyA) were constructed to express secreted alkaline phosphatase (SEAP), EGFP, HIV gag, HCV NS region (as described in FIG. 3 for ChAd6 shuttle vectors) as well as tumor-associated antigens like CEA and HER2/neu from human and Rhesus monkey origin. All expression cassette were inserted into ChAd30 vectors by homologous recombination.

Subgroup C: Subgroup C chimp adenovirus vectors were constructed by homologous recombination in E. coli strain BJ5183. BJ5183 cells were co-transformed with pChAd3EGFP shuttle vector digested with BstEII and Bst1107I and ChAd3, ChAd11, ChAd19 and ChAd20 purified viral DNA. Homologous recombination between pIX genes, right ITR DNA sequences present at the ends of linearized pChAd3EGFP and viral genomic DNA allowed its insertion in the plasmid vector, deleting at the same time the E1 region that was substituted by EGFP expression cassette. Expression cassettes based on human cytomegalovirus (HCMV) promoter and bovine growth hormone polyadenylation signal (Bgh polyA) were constructed to express secreted alkaline phosphatase (SEAP), EGFP, HIV gag, HCV NS region (as described in FIG. 3 for ChAd6 shuttle vectors) as well as tumor-associated antigens like CEA and HER2/neu from human and Rhesus monkey origin.

Figure 4:
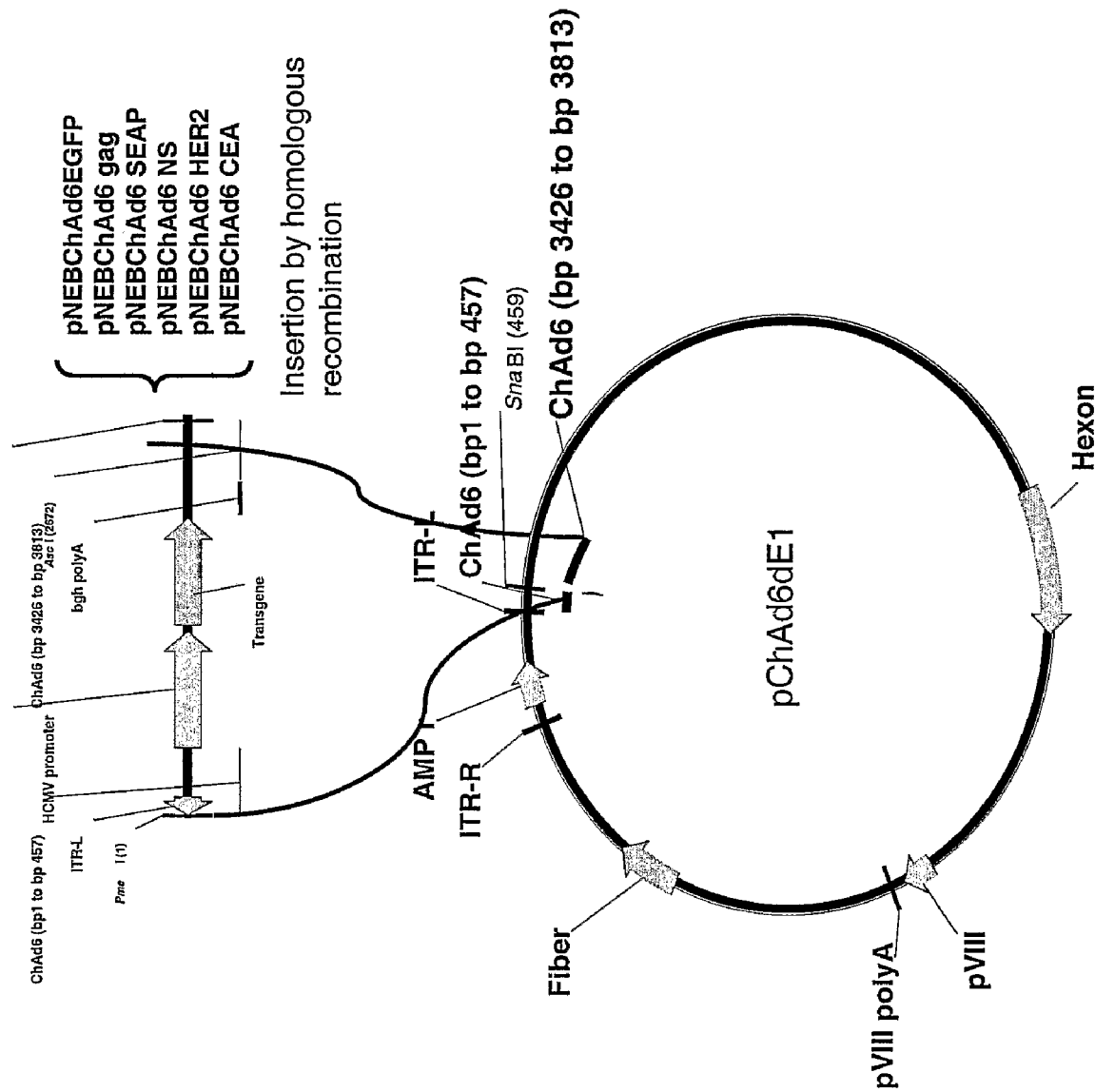
FIG. 4 is a schematic drawing which illustrates the homologous recombination scheme utilized to clone the ChAd6 ΔE1 expression vectors.

Subgroups D and E: In order to construct ΔE1 vectors based on subgroup D and E chimp adenovirus, the shuttle vector pARS ChAd6-3 was digested with AscI and co-transformed into E. coli strain BJ5183 with CV32, CV33, CV68, ChAd4, ChAd5, ChAd6, ChAd7, ChAd9, ChAd10 and ChAd16-purified viral DNA. Homologous recombination between DNA sequences from pIX genes and right ITR present at the ends of linearized pARS ChAd6-3 and viral genomic DNA allowed its insertion in the plasmid vector, deleting at the same time the E1 region (FIGS. 2 and 4).

Expression cassettes based on human cytomegalovirus (HCMV) promoter and bovine growth hormone poly-adenylation signal (Bgh polyA) were constructed to express secreted alkaline phosphatase (SEAP), EGFP, HIV gag, HCV NS genes (FIG. 3) as well as tumor-associated antigens like CEA and HER2/neu of human and Rhesus monkey origin. All the expression cassette were inserted into the single SnaBI site of pARS ChAd6-3 vector to be transferred by homologous recombination into the ΔE1 adenovirus pre-plasmids as described in FIG. 4.

Rescue and Amplification of ΔE1 Vectors $5 \times 10^6$ PER.C6™ cells planted on 6 cm cell culture dishes were transfected with 10 micrograms of cloned viral vector released from plasmid sequences by endonuclease digestion. DNA transfection was performed using Lipofectamine (Invitrogen). Transfected cells and culture medium were collected 5-10 days post-transfection and lysed by freeze-thaw. Rescued vectors were then amplified by serial passaging on 293 or PER.C6™ cells. A large-scale amplification was performed by infecting cells planted on 5-10 cell-factories (NUNC, Inc.) on a total of $1-2 \times 10^9$ cells. A purified vector preparation was obtained on cesium chloride gradient by two ultra-centrifuge runs, dialyzed against PBS containing 10% glycerol and stored at −70° C. in aliquots.

EXAMPLE 3

Neutralization Studies

Neutralization assays were carried out in order to evaluate the prevalence in human sera of neutralizing antibodies against the chimpanzee adenoviruses disclosed herein. The assay evaluated the effects of serum preincubation on the ability of chimp adenoviruses carrying the gene for secreted alkaline phosphatase (SEAP) to transduce human 293 cells. The neutralization titer is defined as the dilution of serum giving a 50% reduction of the SEAP activity observed in the positive control with the virus alone.

From $2\times10^6$ to $1.5\times10^7$ physical particles of CV33-SEAP, CV32-SEAP and ChAd3-SEAP vector were diluted in 100 µl of complete medium and added to an equal volume of human or chimp serum diluted in complete medium. Each serum samples was tested at various dilutions (five 4-fold increments starting from 1/18 dilution through 1:4608). Samples were pre-incubated for one hour at 37° C. and then added to 293 cells seeded into 96-well plates ($3\times10^4$ cells/well). The inoculum was removed after one hour of incubation, the cells were re-fed with fresh medium and, 24 hours later, 50 µl of medium was removed and the SEAP activity was measured by a chemiluminescent assay. The neutralization titer is defined as the dilution of serum giving a 50% reduction of the SEAP activity observed in the positive control with the virus alone. A panel of 100 human sera was tested for ChAd neutralization activity. In parallel the same panel was tested on Ad5 SEAP vector.

TABLE 2

Prevalence of Neutralizing Antibodies Against Chimpanzee Adenovirus

| titer | Virus | | | | | | |
|---|---|---|---|---|---|---|---|
| | hAd5 | CV32 | CV33 | ChAd3 | ChAd30 | ChAd9 | ChAd10 |
| <200 | 77% | 96% | 100% | 92% | 100% | 92% | 100% |
| >200 | 33% | 4% | 0% | 8% | 0% | 6% | 0% |

The result provided in Table 2 indicates that a very low prevalence in human sera of neutralizing antibodies directed against vector derived from chimpanzee adenoviruses. Only four sera showed a titer over the threshold of 200 on CV32 vector while 8 showed a titer over 200 on ChAd3 SEAP vector. On the contrary, the panel of chimp sera examined showed a very high prevalence of anti-Chimp Ad immunity. These findings confirm that as expected, vectors based on chimp Ads have a very little chance to be neutralized in humans. Therefore they represents an ideal solution to the problem of the pre-existing anti-human Ad immunity that limits the administration of viral vectors based on common human Ad serotypes such as Ad5.

EXAMPLE 4

ChAd Vector Tropism

Gene transfer efficacy mediated by Ad5 and ChAd vectors was assessed by EGFP expression on a panel of human primary cells of different histological origin. Human chondrocytes, osteoblasts, keratinocytes, melanocytes, skeletal muscle cells and melanocytes were cultivated according to manufacturer indication. Human monocytes, immature and mature dendritic cells (DC) were obtained as described (Romani, N. et al. 1996, *J. Immunol. Methods*, 196,137). Transduced, fluorescent cells were detected by FACS analysis. The panel of human primary cells tested includes cells that are important target cells for different therapeutic strategies based on in vivo as well as ex vivo gene transfer in the field of cardiovascular disease, rheumatoid arthritis, tissue engineering (bone, skin, and cartilage), and vaccination. The results presented in FIG. 38A-D suggests that different chimp adenoviruses can recognize receptors alternative to CAR as demonstrated by the differential efficiency of infection of the different cell types.

Murine Immunization Studies
Methods and Materials
Immunization Protocols and Splenocyte/PBMC Preparation Immunizations: Mice were immunized with the selected adenoviruses diluted in 0.1 ml of buffer. Each vector dose was divided in two aliquot of 50 µl and injected in both quadriceps of mice.

Splenocyte Preparation: Mice were sacrificed 3 weeks post-injection and their spleens excised and transferred in 10 ml of R10 (10% FCS, 55 mM 2-mercaptoethanol, 1M HEPES buffer, 2 mM L-glutamine, 1× penicillin-streptomicine solution in RPMI medium 1640). Spleens were minced through a steel screen and, after the screen was washed with 2 ml of R10, splenocytes were transferred in a50 ml Falcon tube and centrifuged at 1200 rpm, 10 min, room temperature (rt). Supernatant was removed and 3 ml of ACK lysis buffer (Gibco BRL Formulation #79-0422DG) were added. Cells were incubated 5' min, rt. 45 ml of 1×PBS were added and tubes were centrifuged as above. After washing with 30 ml of R10, cells were resuspended in 5 ml of R10, filtered through a 70 m Nylon cell strainer (Falcon 2350). 10 µl of cells were diluted with 990 µl Turk's solution (Merck 040417345) and counted. Cells were finally diluted to $10^7$ cells/ml in R10.

Peripheral blood mononuclear cell (PBMC) preparation: Mice blood samples (150 ul) were transferred to 2 ml eppendorf tubes with 50 ul PBS/2% EDTA. 1 ml ACK buffer was added to each tube. Gently mixed and incubated at RT for 5 min. Samples were centrifuged at 1500 rpm in microcentrifuge for 5 min. Supernatant was discharged white cell pellets deriving from the same immunized cohorts were combined. ACK buffer incubation was repeated then pellets of PBMC were resuspended in 1 ml of R10 medium.

IFN-γ ELISPOT Assay

Millipore MAIP 45 plates were coated with 100 µl/well of purified rat anti-mouse IFN-γ monoclonal antibody (Pharmingen, cat. 551216) diluted at 2.5 µg/ml in PBS and incubated over-night (o/n) at 4° C. Plates were washed 2× with sterile PBS and un-specific binding sites were blocked by incubation for 2 hrs in the $CO_2$ incubator with 200 µl/well of R10. In the immunization experiments with Ad vectors expressing HIV gag, a 9-mer peptide (AMQMLKETI, a CD8 HIV gag epitope mapped in Balb/C mice) (SEQ ID NO: 47) was diluted to 2 µg/ml in R10 and added to the wells in the amount of 50 µl/well. In immunization experiments conducted with HCV-NS expressing vectors, a pool of peptides covering NS3 helicase domain as well a 9-mer peptide representing a mapped CD8 epitope comprised in helicase domain were used. Immunization experiments with ChAds expressing human CEA antigen were evaluated by pools of overlapping 15-mer peptides covering the entire amino acid sequence. As controls DMSO and Concanavalin A were used. Cells were added to each well at the amount of $5\times10^5$ and $2.5\times10^5$. After an o/n incubation in the CO$_2$ incubator, plates were washed with 0.05% Tween 20/PBS and 50 μl/well of biotinylated rat anti-mouse IFN-γ monoclonal antibody (PharMingen cat. 554410) diluted 1/250 in assay buffer (5% FBS, 0.005% Tween 20, PBS) were added. Plates were incubated o/n at 4° C. and washed as above. Streptavidin-alkaline phosphatase conjugate (BD554065) was diluted 1/2500 in assay buffer and added in the amount of 50 μl/well for 2 hrs rt. After washing, plates were developed adding 50 μl/well of BCIP/NBT1-step solution (Pierce 34042). Reaction was stopped by washing wells with deionized water. Spots were automatically counted by an ELISPOT reader.

Murine IFN-γ Intracellular Staining (ICS)

Splenocytes were diluted at 2×10$^6$ cells in 1 ml of R10 and stimulated with the same antigens described above at the concentration of 2 μg/ml. As controls, DMSO and Staphylococcal Enterotoxin B (SEB) were used. After an overnight incubation in the CO$_2$ incubator, cells were washed with FACS buffer (1% FCS, 0.01% NaN3, PBS) and purified anti-mouse CD16/CD32 Fc block (clone 2.4G2, Pharmingen cat. 553142) was diluted 1/25, added in the amount of 100 μl/sample and incubated for 15 min at 4° C. Cells were washed in FACS buffer and APC conjugated anti-mouse CD3e (clone 145-2C11, Pharmingen #553066), PE conjugated anti-mouse CD4 (clone L3T4, BD Pharmingen cat. 553142) and PerCP conjugated anti-mouse CD8a (clone 53-6.7, Pharmingen cat. 553036) diluted 1:50 in FACS buffer were added in the amount of 100 μl/sample. Cells were incubated 30 min rt, washed, fixed and permeabilized (Becton Dickinson, FACS Perm 2) and incubated with FITC conjugated anti-mouse IFN-γ Pharmingen cat. 554411) diluted 1:50 in PermWash (100 μl/sample) for 30 min at RT. After washing cells were resuspended in 500 ul 1% formaldehyde/PBS and intracellular cytokine staining (ICS) analyzed on a FACS-Calibur flow cytometer, using CellQuest software (Becton Dickinson).

EXAMPLE 5

ChAd Vectors Elicit Strong CMI Responses in Mice

The ability of the ChAd vectors disclosed herein to elicit a cell-mediated immune response (CMI) was evaluated in mice using vectors expressing an HIV gag transgene. Briefly, groups of 5 Balb/C mice were injected with ten-fold increasing doses of the different vectors starting from 10$^5$ up to 10$^{10}$ vp/mouse.

The strength of the immune response was determined three weeks after the injection by quantifying gag-specific CD8+ T cells in the splenocytes. The number of IFN-γ secreting CD8+ T cells was determined by ELISPOT assay or by IFN-γ intracellular staining and FACS analysis after stimulation in vitro with a peptide reproducing a gag CD8+ T cell epitope mapped in Balb/C mice.

The results obtained from the 5 immunized animals, reported in Table 3, are expressed as spot forming cells per 10$^6$ splenocytes. Shown are the number of spot forming cells per million splenocytes following incubation with 9-mer CD8+ gag epitope or with gag peptide pool. The gag peptide pool consisted of 20-aa peptide overlapping by 10aa encompassing the entire gag sequence. Positive values are reported in bold.

Figure 33:
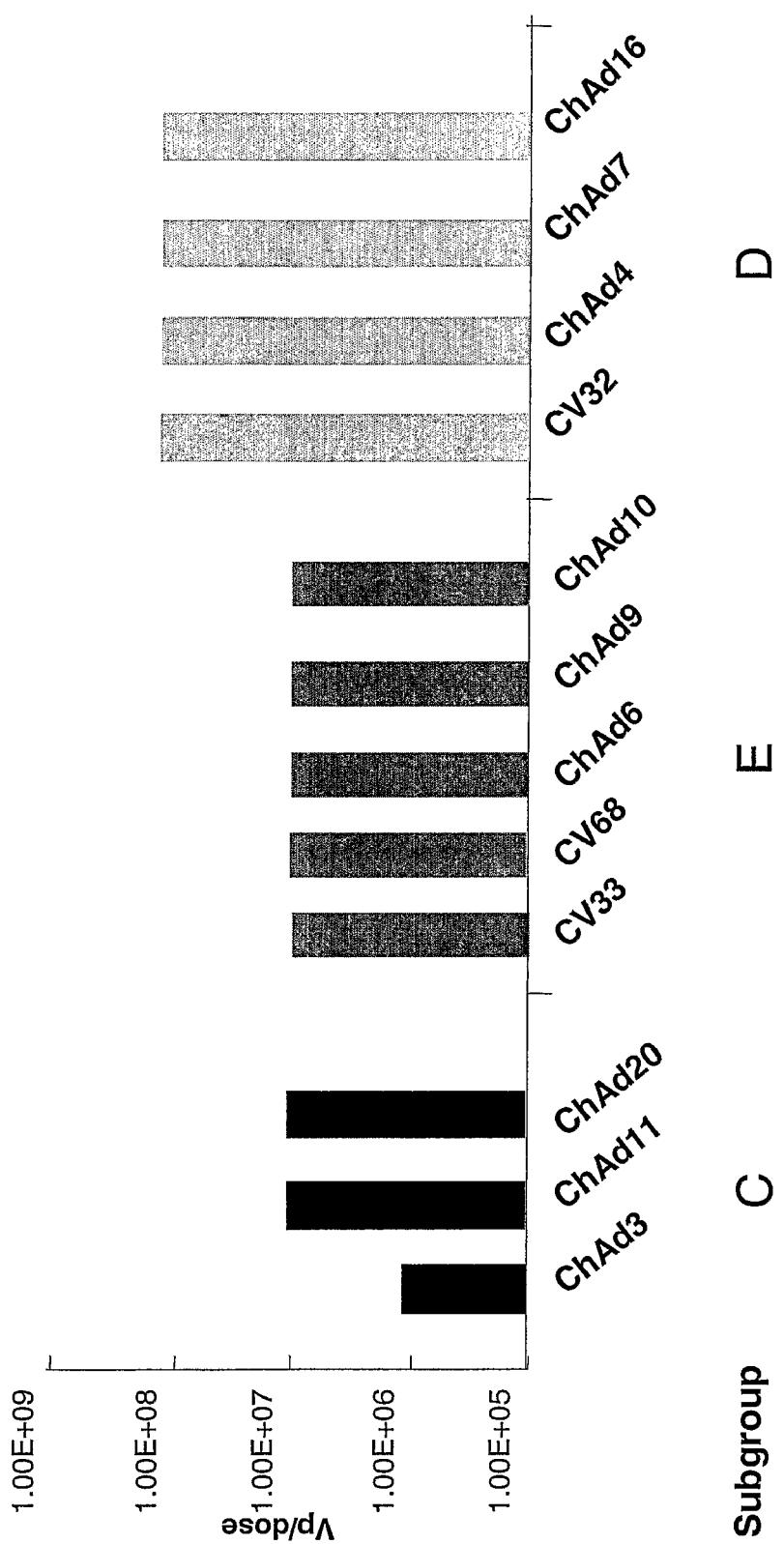
FIG. 33 is a graphic representation of the immunization break-point of ChAd vectors belonging to different serotype subgroups (i.e., subgroups C, E and D). The lowest dose eliciting a measurable immune response was determined by performing titration experiments in mice immunized with gag-expressing ChAd3, ChAd11, ChAd20, CV33, CV68, ChAd6, ChAd9, ChAd10, CV32, ChAd4, ChAd7 and ChAd16 vectors.

The data provided in Table 3 indicate that the administration of the ChAd vectors disclosed and claimed herein elicits a strong cell mediated immune response which is comparable to the response elicited by hAd5. By looking at the lowest vector dose resulting in a positive immunization result (immunization breakpoint), we ranked the potency of the different vectors being subgroup C ChAd3gag the most potent with a breakpoint at 10$^6$ pp vector dose. Ranking by immunization break-points is shown in FIG. 33.

TABLE 3

Gag-Specific T Cell Response in Balbc Mice Immunized with Chimpanzee Ad Vectors

| Vaccination | 10^5 vp | | 10^6 vp | | 10^7 vp | | 10^8 vp | | 10^9 vp | | 10^10 vp | |
|---|---|---|---|---|---|---|---|---|---|---|---|---|
| | mock | Gag | mock | Gag | mock | Gag | mock | Gag | mock | Gag | mock | Gag |
| ChAd3DE1gag | 1 | neg | 1 | 944 | 1 | 1298 | 1 | 1258 | NT | NT | NT | NT |
| | 3 | neg | 1 | 1039 | 1 | 1958 | 1 | 1962 | NT | NT | NT | NT |
| | 1 | neg | 1 | 859 | 1 | 1923 | 1 | 1931 | NT | NT | NT | NT |
| | 1 | neg | 1 | 1620 | 1 | 1386 | 1 | 1369 | NT | NT | NT | NT |
| | 1 | neg | 1 | 1529 | 5 | 1442 | 4 | 1436 | NT | NT | NT | NT |
| CV33DE1gag | NT | NT | 1 | neg | 2 | 475 | 1 | 2910 | NT | NT | NT | NT |
| | NT | NT | 1 | neg | 1 | 433 | 1 | 401 | NT | NT | NT | NT |
| | NT | NT | 1 | neg | 1 | 243 | 1 | 634 | NT | NT | NT | NT |
| | NT | NT | 1 | neg | 1 | 505 | 2 | 3457 | NT | NT | NT | NT |
| | NT | NT | 1 | neg | 1 | 683 | 2 | 1684 | NT | NT | NT | NT |
| CV68DE1gag | NT | NT | 3 | neg | 1 | 340 | 2 | 332 | 0 | 406 | 2 | 635 |
| | NT | NT | 1 | neg | 1 | 512 | 0 | 536 | 1 | 256 | 3 | 1172 |
| | NT | NT | 0 | neg | 2 | 458 | 3 | 944 | 2 | 462 | 2 | 505 |
| | NT | NT | 7 | neg | 0 | 148 | 1 | 519 | 0 | 488 | 2 | 1184 |
| | NT | NT | 0 | neg | 2 | 1418 | 1 | 243 | 0 | 240 | 1 | 789 |
| ChAd9DE1gag | NT | NT | 1 | neg | 7 | 369 | 1 | 609 | NT | NT | NT | NT |
| | NT | NT | 1 | neg | 1 | 508 | 1 | 739 | NT | NT | NT | NT |
| | NT | NT | 1 | neg | 1 | 299 | 16 | 291 | NT | NT | NT | NT |
| | NT | NT | 1 | neg | 2 | 507 | 8 | 926 | NT | NT | NT | NT |
| | NT | NT | 0.5 | neg | 1 | 36 | 40 | 1034 | NT | NT | NT | NT |
| ChAd10DE1gag | NT | NT | 1 | neg | 1 | 83 | 1 | 822.5 | NT | NT | NT | NT |
| | NT | NT | 1 | neg | 1 | 42.5 | 1 | 1033 | NT | NT | NT | NT |
| | NT | NT | 1 | neg | 1 | 48 | 1 | 1339.5 | NT | NT | NT | NT |
| | NT | NT | 1 | neg | 4 | 51 | 1 | 1132 | NT | NT | NT | NT |
| | NT | NT | 1 | neg | 1 | 466.5 | 1 | 521.5 | NT | NT | NT | NT |
| ChAd6DE1gag | NT | NT | 1 | neg | 1 | 34 | 1 | 721 | NT | NT | NT | NT |
| | NT | NT | 1 | neg | 10 | 4 | 1 | 560 | NT | NT | NT | NT |
| | NT | NT | 1 | neg | 1 | 24 | 1 | 624 | NT | NT | NT | NT |

TABLE 3-continued

Gag-Specific T Cell Response in Balbc Mice Immunized with Chimpanzee Ad Vectors

| Vaccination | 10^5 vp | | 10^6 vp | | 10^7 vp | | 10^8 vp | | 10^9 vp | | 10^10 vp | |
|---|---|---|---|---|---|---|---|---|---|---|---|---|
| | mock | Gag | mock | Gag | mock | Gag | mock | Gag | mock | Gag | mock | Gag |
| | NT | NT | 1 | neg | 1 | 225 | 3 | 3002 | NT | NT | NT | NT |
| | NT | NT | 1 | neg | 1 | 276 | 4 | 1738 | NT | NT | NT | NT |
| ChAd11DE1gag | 1 | neg | 1 | neg | 0 | 573 | NT | NT | NT | NT | NT | NT |
| | 0 | neg | 0 | neg | 0 | 919 | NT | NT | NT | NT | NT | NT |
| | 0 | neg | 1 | neg | 1 | 1438 | NT | NT | NT | NT | NT | NT |
| | 2 | neg | 0 | neg | 0 | 0 | NT | NT | NT | NT | NT | NT |
| | 1 | neg | 1 | neg | 0 | 456 | NT | NT | NT | NT | NT | NT |
| ChAd20DE1gag | 0 | neg | 0 | neg | 0 | 1 | NT | NT | NT | NT | NT | NT |
| | 2 | neg | 0 | neg | 0 | 408 | NT | NT | NT | NT | NT | NT |
| | 0 | neg | 0 | neg | 0 | 414 | NT | NT | NT | NT | NT | NT |
| | 1 | neg | 0 | neg | 0 | 2 | NT | NT | NT | NT | NT | NT |
| | 0 | neg | 0 | neg | 1 | 311 | NT | NT | NT | NT | NT | NT |
| ChAd7DE1gag | NT | NT | 1 | neg | 1 | neg | 1 | 1044 | NT | NT | NT | NT |
| | NT | NT | 3 | neg | 1 | neg | 1 | 606 | NT | NT | NT | NT |
| | NT | NT | 1 | neg | 8 | neg | 1 | 407 | NT | NT | NT | NT |
| | NT | NT | 1 | neg | 1 | neg | 2 | 567 | NT | NT | NT | NT |
| | NT | NT | 1 | neg | 3 | neg | 1 | 1677 | NT | NT | NT | NT |
| CV32DE1gag | NT | NT | NT | NT | 1 | neg | 0 | 83 | 0 | 291 | 0 | 194 |
| | NT | NT | NT | NT | 3 | neg | 0 | 382 | 0 | 805 | 2 | 380 |
| | NT | NT | NT | NT | 0 | neg | 1 | 97 | 0 | 136 | 1 | 501 |
| | NT | NT | NT | NT | 1 | neg | 5 | 96 | 4 | 1162 | 0 | 1115 |
| | NT | NT | NT | NT | 2 | neg | 1 | 328 | NT | NT | 0 | 596 |
| ChAd4DE1gag | NT | NT | 1 | neg | 0 | neg | 0 | 0 | NT | NT | NT | NT |
| | NT | NT | 0 | neg | 0 | neg | 0 | 159 | NT | NT | NT | NT |
| | NT | NT | 0 | neg | 0 | neg | 0 | 1 | NT | NT | NT | NT |
| | NT | NT | 1 | neg | 0 | neg | 0 | 234 | NT | NT | NT | NT |
| | NT | NT | 1 | neg | 0 | neg | 1 | 0 | NT | NT | NT | NT |
| ChAd16DE1gag | NT | NT | 0 | neg | 0 | neg | 0 | 243 | NT | NT | NT | NT |
| | NT | NT | 0 | neg | 0 | neg | 1 | 296 | NT | NT | NT | NT |
| | NT | NT | 0 | neg | 2 | neg | 1 | 68 | NT | NT | NT | NT |
| | NT | NT | 0 | neg | 0 | neg | 1 | 433 | NT | NT | NT | NT |
| | NT | NT | 1 | neg | 0 | neg | 1 | 28 | NT | NT | NT | NT |

EXAMPLE 6

ChAd3 and CV33 GAG Vectors Elicit a CMI Response Characterized by GAG-Specific CD8+ T Cells In order to characterize the CMI response elicited in response to the ChAd vectors comprising HIV gag transgene, splenocytes pooled from cohorts of five mice immunized with different doses of vector were analyzed by intracellular IFN-γ staining. The data shown in table 3 and table 4 were collected in separate experiments.

Splenocytes were diluted at $2 \times 10^6$ cells in 1 ml of R10 and stimulated with the same antigens described above at the concentration of 2 μg/ml. As controls, DMSO and SEB (Staphylococcal Enterotoxin B) were used. After an o/n incubation in the $CO_2$ incubator, cells were washed with FACS buffer (1% FCS, 0.01% NaN3, PBS) and purified anti-mouse CD16/CD32 Fc block (clone 2.4G2, Pharmingen cat. 553142) was diluted 1/25, added in the amount of 100 μl/sample and incubated for 15 min at 4° C. Cells were washed in FACS buffer and APC conjugated anti-mouse CD3e (clone 145-2C11, Pharmingen #553066), PE conjugated anti-mouse CD4 (clone L3T4, BD Pharmingen cat. 553142) and PerCP conjugated anti-mouse CD8a (clone 53-6.7, Pharmingen cat. 553036) diluted 1:50 in FACS buffer were added in the amount of 100 μl/sample. Cells were incubated 30 min rt, washed, fixed and permeabilized (Becton Dickinson, FACS Perm 2) and incubated with FITC conjugated anti-mouse IFN-γ Pharmingen cat. 554411) diluted 1:50 in PermWash (100 μl/sample) for 30 min at RT. After washing cells were resuspended in 500 ul 1% formaldehyde/PBS and analyzed on a FACS-Calibur flow cytometer, using CellQuest software (Becton Dickinson).

Table 4 provides data summarizing the percentage of gag-specific CD3+ T cells that were either gag-specific CD8+ or CD4+ T cells. Positive results are reported in bold. The data provided herein indicate that the cellular profile of the immune response elicited by ChAd vectors derived from viruses classified into different serotype subgroups (i.e., subgroups C, D and E) are similar and all of the gag-specific responses characterized predominantly by CD8+ T cells. In addition, it is noted that at high vector doses a gag-specific CD4+ response becomes evident in all immunization experiments. The ICS assay confirmed that ChAd3 vector can stimulate anti-gag CD8+ response at $10^6$ vector dose.

TABLE 4

Characterization of Gag-Specific T Cells in Mice Immunized with Chimp Adenovirus Vectors of Different Subgroups

| vaccine | | $10^5$ DMSO | $10^5$ gag | $10^6$ DMSO | $10^6$ gag | $10^7$ DMSO | $10^7$ gag | $10^8$ DMSO | $10^8$ gag | $10^9$ DMSO | $10^9$ gag |
|---|---|---|---|---|---|---|---|---|---|---|---|
| ChAd3DE1gag | % CD8+CD3+ | NT | NT | 0.01% | 4.65% | 0.01% | 17.15% | 0.04% | 24.71% | NT | NT |
|  | % CD4+CD3+ | NT | NT | 0.00% | 0.07% | 0.03% | 0.08% | 0.04% | 0.28% | NT | NT |
| CV33DE1gag | % CD8+CD3+ | NT | NT | 0.02% | 0.01% | 0.01% | 0.83% | 0.03% | 8.69% | NT | NT |
|  | % CD4+CD3+ | NT | NT | 0.00% | 0.00% | 0.00% | 0.04% | 0.01% | 0.10% | NT | NT |
| ChAd9DE1gag | % CD8+CD3+ | NT | NT | 0.02% | 0.01% | 0.01% | 0.68% | NT | NT | 0.04% | 4.73% |
|  | % CD4+CD3+ | NT | NT | 0.00% | 0.00% | 0.00% | 0.00% | NT | NT | 0.00% | 0.01% |
| ChAd10DE1gag | % CD8+CD3+ | NT | NT | 0.02% | 0.01% | 0.01% | 0.57% | NT | NT | 0.02% | 5.04% |
|  | % CD4+CD3+ | NT | NT | 0.00% | 0.00% | 0.00% | 0.00% | NT | NT | 0.00% | 0.01% |
| ChAd6DE1gag | % CD8+CD3+ | NT | NT | 0.00% | 0.01% | 0.00% | 0.59% | 0.01% | 14.28% | NT | NT |
|  | % CD4+CD3+ | NT | NT | 0.00% | 0.00% | 0.00% | 0.05% | 0.01% | 0.12% | NT | NT |
| ChAd7DE1gag | % CD8+CD3+ | NT | NT | 0.01% | 0.02% | 0.01% | 0.00% | 0.02% | 5.00% | NT | NT |
|  | % CD4+CD3+ | NT | NT | 0.00% | 0.01% | 0.00% | 0.00% | 0.01% | 0.21% | NT | NT |

EXAMPLE 7

ChAd Vectors Elicit HCV NS-Specific T Cell Response

The potency of CV32-NSmut and CV33-NSmut vectors was evaluated in C57/Black6 mice relative to the potency of MRKAd6NSmut. The animals were injected with 10-fold increasing doses of vector starting from $10^7$ up to $10^9$ vp/mouse. CMI was analyzed 3 weeks after a single injection by IFN-γ ELISPOT and IFN-γ intracellular staining by stimulating T cells with a 9-mer peptide reproducing a CD8+ T cell epitope mapped in the helicase domain of NS3 protein. The data provided in Table 5 summarize the number of spot-forming cells per million splenocytes following incubation in absence (mock) or in presence of NS3 9-mer peptide.

The data indicate that both CV32 and CV33 vectors expressing HCV-NS stimulate strong T cell responses. Based on the observation that the first positive result for the CV32 vector was obtained by injecting $10^9$ vp/dose, the immunization potency of CV32DE1E3 NSmut vector appears to be approximately 100-fold lower than human subgroup C Ad6DE1E3 NSmut vector. The parallel experiment with MRKAd6NSmut indicated that a dose of $10^7$ vp/animal was sufficient to stimulate cell mediated immunity. Therefore, these results confirm the lower immunization potency of CV32-derived vectors relative to human subgroup C vectors (such as hAd5 and hAd6) that was also observed in the experiment with gag expressing vectors (see Table 3).

TABLE 5

HCV NS-Specific T Cell Response in Mice Immunized with Mrkad6 Nsmut, CV32NSmut or CV33NSmut

| Vaccination | $10^7$ vp Mock | $10^7$ vp NS3 | $10^8$ vp mock | $10^8$ vp NS3 | $10^9$ vp mock | $10^9$ vp NS3 | $10^{10}$ vp mock | $10^{10}$ vp NS3 |
|---|---|---|---|---|---|---|---|---|
| MRKAd6NSmut | 1 | 345 | 1 | 449 | NT | NT | NT | NT |
|  | 1 | 248 | 1 | 1590 | NT | NT | NT | NT |
|  | 1 | 1 | 1 | 549 | NT | NT | NT | NT |
|  | 1 | 262 |  |  | NT | NT | NT | NT |
|  | NT | NT |  |  | NT | NT | NT | NT |
| CV33NSmut | 1 | 1 | 1 | 195 | 2 | 338 | NT | NT |
|  | 1 | 2 | 1 | 409 | 1 | 1136 | NT | NT |
|  | 1 | 1 | 1 | 396 | 1 | 497 | NT | NT |
|  | 1 | 2 | 2 | 172 | 1 | 344 | NT | NT |
|  | 1 | 237 |  |  | 1 | 163 | NT | NT |
| CV32NSmut | neg | neg | 1 | 181 | 1 | 118 | 1 | 176 |
|  | neg | neg | 1 | 71 | 1 | 239 | 1 | 238 |
|  | neg | neg | 1 | 56 | 1 | 862 | 1 | 555 |
|  | neg | neg | 1 | 459 | 1 | 219 | 1 | 545 |
|  | neg | neg | 1 | 195 | 1 | 123 | 1 | 578 |

EXAMPLE 8

Anti-Ad5 Pre-Existing Immunity Does Not Abrogate Anti-GAG CMI Elicited by ChAd3gag To evaluate the impact on ChAd3 immunization of the pre-existing immunity against the high seroprevalent Ad5, 4 cohorts of 5 BalbC mice were pre-immunized with two injection of $10^{10}$ vp of Ad5 wt in the quadriceps at week 0 and 2. As control, 2 cohorts of 5 mice were injected at the same time points with buffer only. Cohorts of Ad5 pre-immunized mice were then immunized with $10^6$ and $10^7$ vp/mouse of either Ad5gag or ChAd3gag vectors. Cohorts of control (naïve) mice were immunized with 106 vp/mouse of Ad5gag or ChAd3gag vectors.

Anti-Ad5 and ChAd3 neutralizing immunity was evaluated at week 4 by the neutralization assay described above using Ad5 and ChAd3 SEAP vectors. Anti-gag immunity was evaluated by ELISPOT analysis on purified splenocytes stimulated with gag 9-mer peptide containing a gag epitope mapped in BalbC mice. The results reported in FIG. 36 demonstrated that Anti-Ad5 immunity does not abrogate anti-gag CMI elicited by ChAd3gag while, as expected, anti-Ad5 immunity completely block Ad5gag immunization.

EXAMPLE 9

ChAd3hCEA Immunization Elicits a Strong CEA-Specific Immune Response in Transgenic Mice Expressing Human CEA The ability of the ChAd vectors disclosed and claimed herein to elicit an immune response against a self-antigen therefore breaking the tolerance was also evaluated in transgenic mice expressing human CEA (Clarke, P et al. *Cancer Res.* (1998) 58(7):1469-77.)

Cohorts of 8 mice were injected in the quadriceps with $10^{\wedge}10$ vp of ChAd3hCEA or Ad5hCEA as already described. The immune response against CEA was followed weekly up to day 75 on PBMC stimulated with a pool of 15-mer peptides encompassing human CEA amino acid sequence from aa 497 to the end (aa 703). Anti-CEA immunity was evaluated by ICS determining CD4-CD8+ T cells secreting interferon-γ in response to CEA peptide pool incubation.

Figure 37:
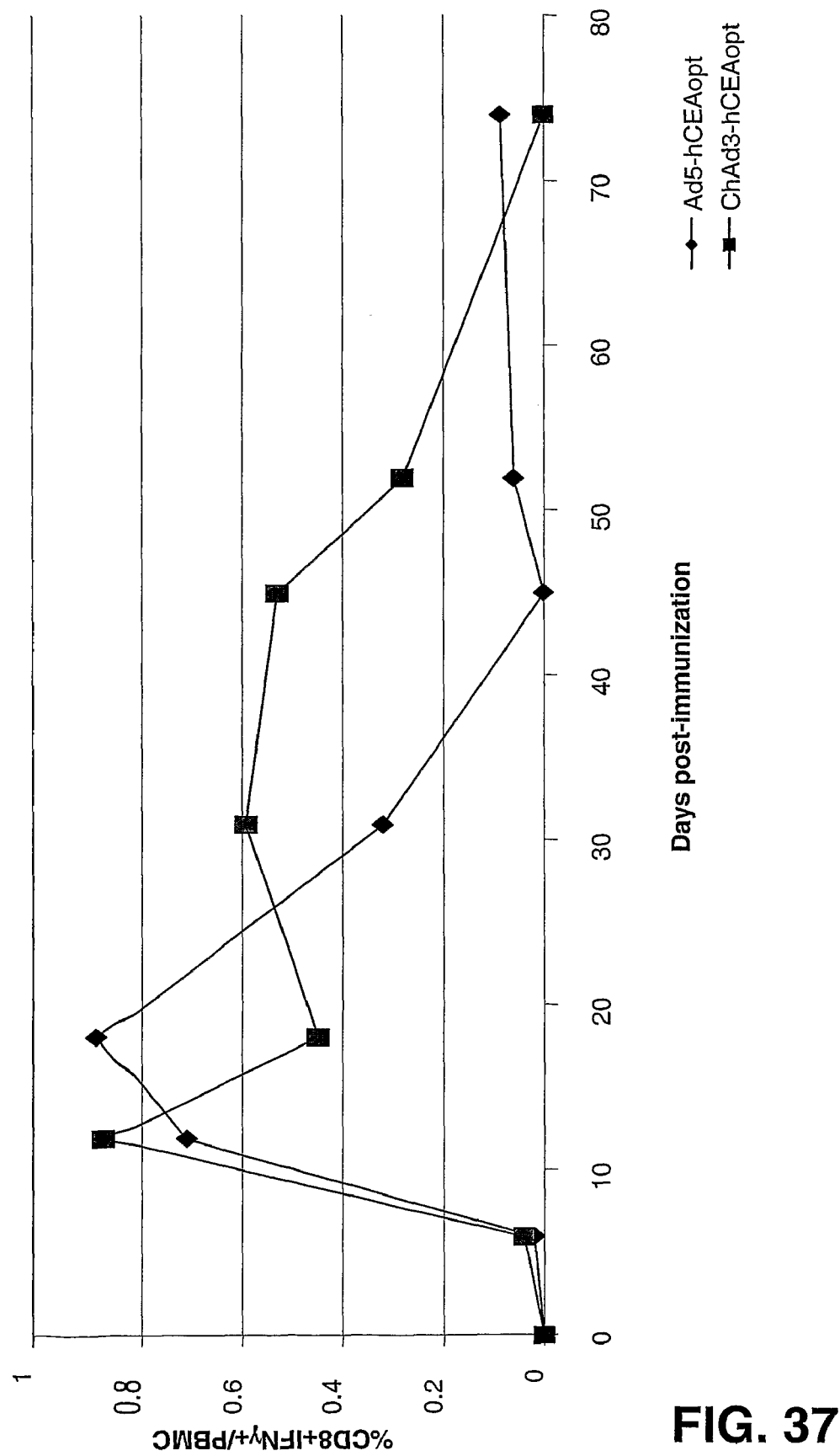
FIG. 37 is a graphic representation of kinetics of anti-CEA CMI elicited in human CEA transgenic mice immunized with ChAd3hCEA and Ad5hCEA. CMI was evaluated by ICS of PBMC stimulated with CEA peptide pool. The results are expressed as % of IFNγ+ CD8+/total PBMC.
Figure 38A:
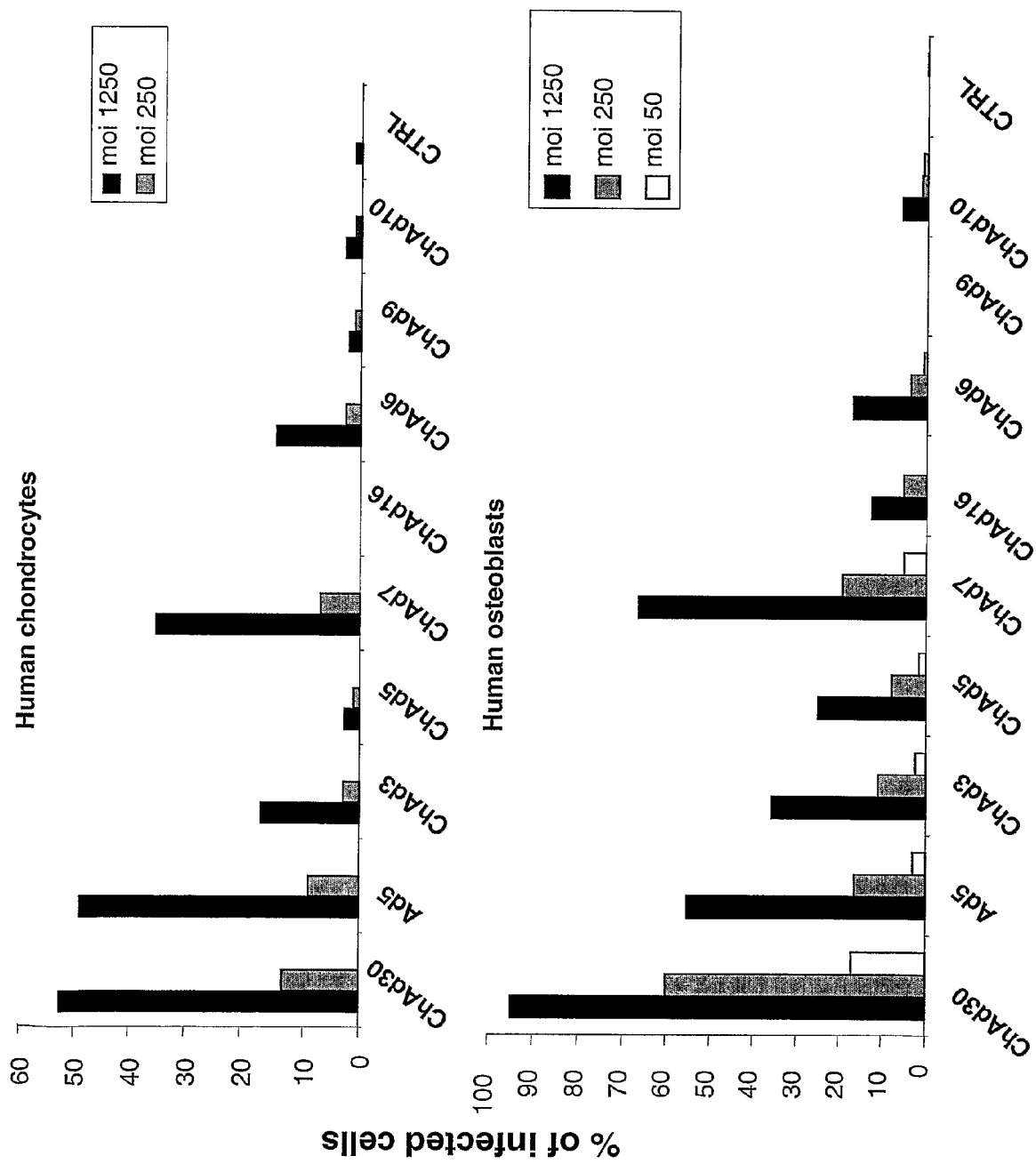
FIGS. 38 A-D is a graphic representation of the efficiency of infection of different human primary cells exposed to moi 50, 250 and 1250 of different ChAd vectors expressing EGFP and belonging to different subgroups (B, C, D, E). The results are expressed as % of fluorescent cells/on total cells.
Figure 38B:
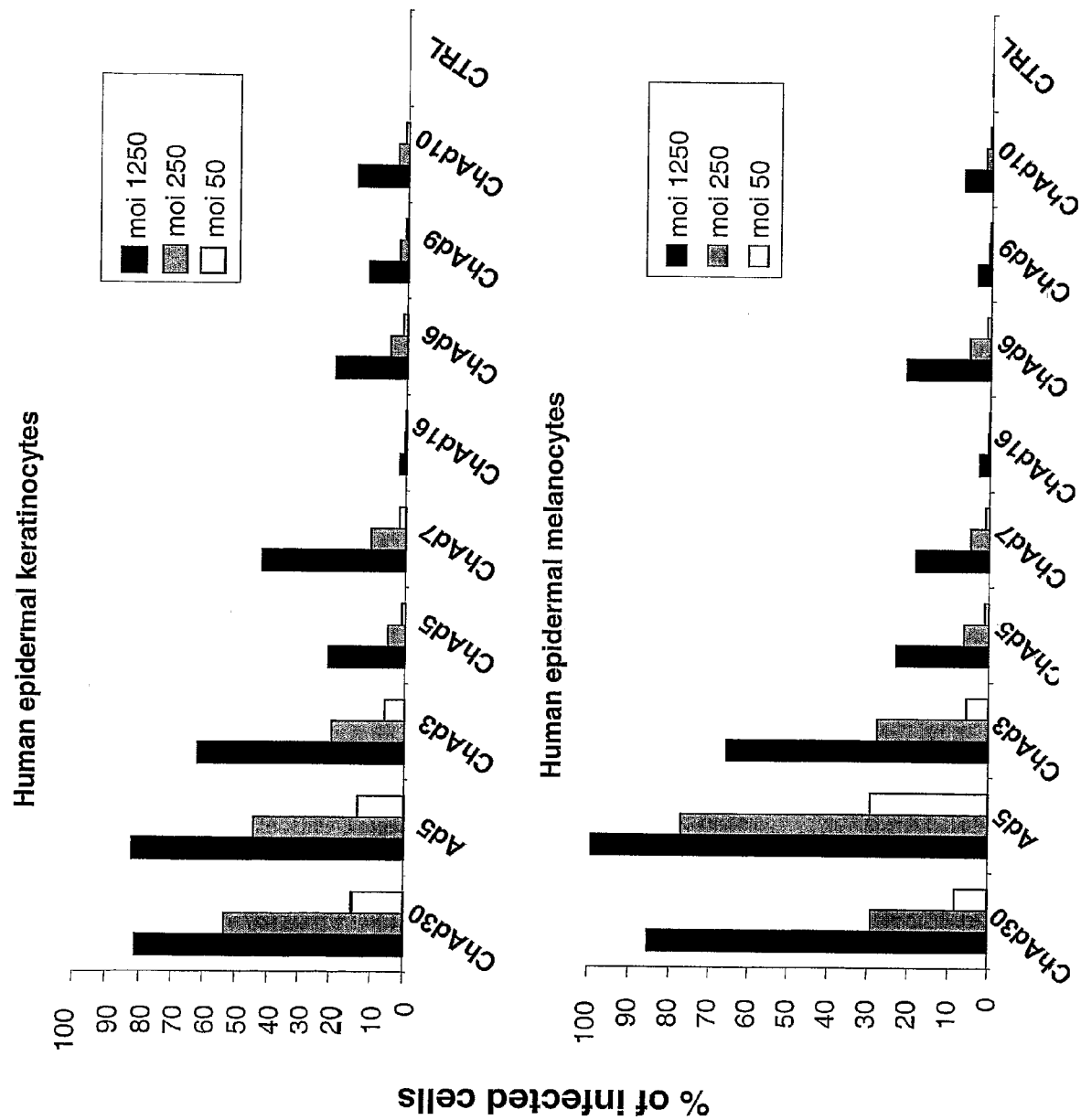
Figure 38C:
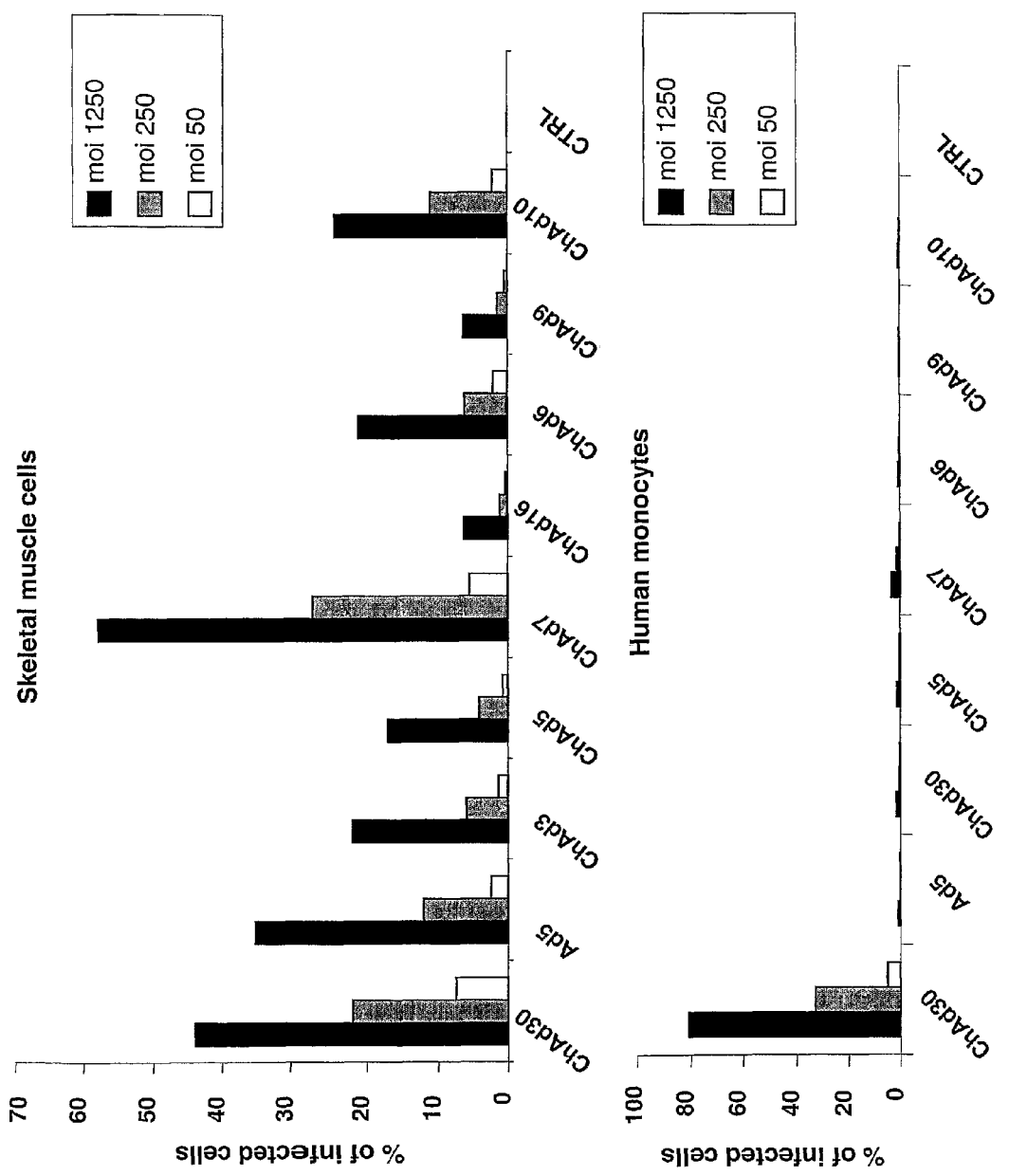
Figure 38D:
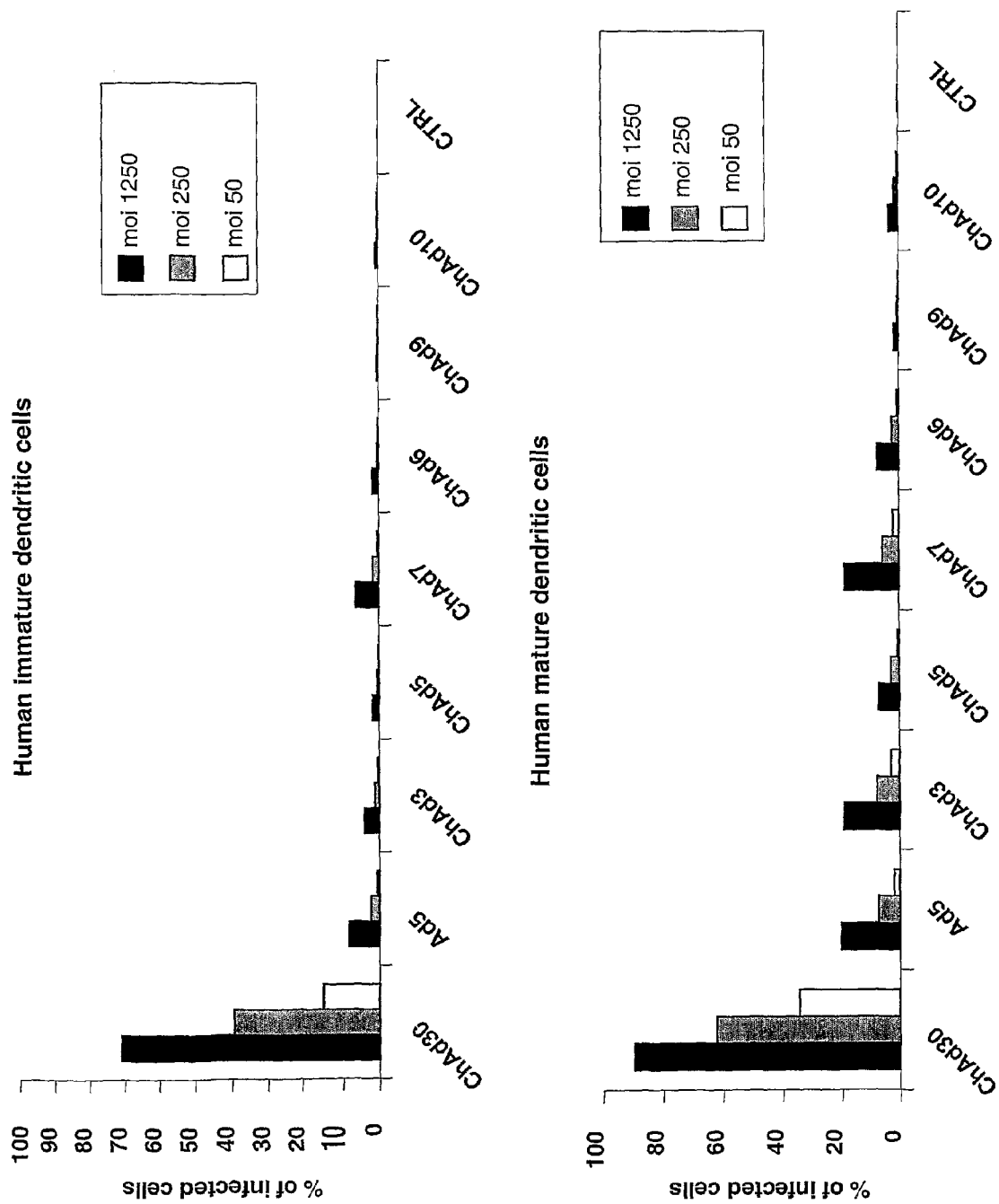

The results reported in FIG. 37 demonstrate that ChAd3hCEA vector immunization stimulate a more sustained CD8+ T cell response against human CEA than Ad5 expressing the same transgene.

Primate Immunization Studies
Methods and Materials
Immunization Protocol

The ability of the ChAd vectors disclosed and claimed herein to elicit CMI in Rhesus macaques (referred to herein as monkeys) was also evaluated. The macaques were anesthetized (ketamine/xylazine) and the vaccines were delivered i.m. in 0.5-mL aliquots into both deltoid muscles using tuberculin syringes (Becton-Dickinson). In all cases the macaques were between 3-10 kg in weight, and the total dose of each vaccine was administered in 1 mL of buffer.

Sera and peripheral blood mononuclear cells (PBMC) were prepared from blood samples collected at several time points during the immunization regimen. All animal care and treatment were in accordance with standards approved by the Institutional Animal Care and Use Committee according to the principles set forth in the *Guide for Care and Use of Laboratory Animals*, Institute of Laboratory Animal Resources, National Research Council.

ELISPOT Assay

The IFN-γ ELISPOT assays for rhesus macaques were conducted following a previously described protocol (Allen et al., 2001 *J. Virol.* 75(2):738-749), with some modifications. For gag-specific stimulation, a peptide pool was prepared from 20-aa peptides that encompass the entire HIV-1 gag sequence with 10-aa overlaps (Synpep Corp., Dublin, Calif.). For HCV NS-specific stimulation 6 peptide pools were prepared from 15-aa peptides that encompass the entire HCV-NS sequence from NS3 to NS5b with 10-aa overlaps.

HER2/neu and CEA-specific stimulations were performed with 15-aa peptides that encompass the entire protein sequence with 10-aa overlaps.

To each well, 50 μL of $2-4\times10^5$ peripheral blood mononuclear cells (PBMCs) were added; the cells were counted using Beckman Coulter Z2 particle analyzer with a lower size cut-off set at 80 fL. Either 50 μL of media or the gag peptide pool at 8 μg/mL concentration per peptide was added to the PBMC. The samples were incubated at 37° C., 5% $CO_2$ for 20-24 hrs. Spots were developed accordingly and the plates were processed using custom-built imager and automatic counting subroutine based on the ImagePro platform (Silver Spring, Md.); the counts were normalized to $10^6$ cell input.

Intracellular Cytokine Staining (ICS)

To 1 ml of $2\times10^6$ PBMC/mL in complete RPMI media (in 17×100 mm round bottom polypropylene tubes (Sarstedt, Newton, N.C.)), anti-hCD28 (clone L293, Becton-Dickinson) and anti-hCD49d (clone L25, Becton-Dickinson) monoclonal antibodies were added to a final concentration of 1 μg/mL. For gag-specific stimulation, 10 μL of the peptide pool (at 0.4 mg/mL per peptide) were added. Similar conditions were used for HCV NS-specific stimulation. The tubes were incubated at 37° C. for 1 hr., after which 20 μL of 5 mg/mL of brefeldin A (Sigma) were added. The cells were incubated for 16 hr at 37° C., 5% $CO_2$, 90% humidity. 4 mL cold PBS/2%1-BS were added to each tube and the cells were pelleted for 10 min at 1200 rpm. The cells were re-suspended in PBS/2% FBS and stained (30 min, 4° C.) for surface markers using several fluorescent-tagged mAbs: 20 μL per tube anti-hCD3-APC, clone FN-18 (Biosource); 20 μL anti-hCD8-PerCP, clone SK1 (Becton Dickinson, Franklin Lakes, N.J.); and 20 μL anti-hCD4-PE, clone SK3 (Becton Dickinson). Sample handling from this stage was conducted in the dark. The cells were washed and incubated in 750 μL 1×FACS Perm buffer (Becton Dickinson) for 10 min at room temperature. The cells were pelleted and re-suspended in PBS/2% FBS and 0.1 μg of FITC-anti-hIFN-γ, clone MD-1 (Biosource) was added. After 30 min incubation, the cells were washed and re-suspended in PBS. Samples were analyzed using all four color channels of the Becton Dickinson FACSCalibur instrument. To analyze the data, the low side- and forward-scatter-lymphocyte population was initially gated; a common fluorescence cut-off for cytokine-positive events was used for both $CD4^+$ and $CD8^+$ populations, and for both mock and gag-peptide reaction tubes of a sample.

EXAMPLE 10

A Homologous Prime-Boost Regimen Using ChAd ΔE1-gag Vectors Elicits Gag-Specific T Cells in Monkeys Cohorts of 3 animals were given intramuscular injection at week 0 and week 4 of either of the following constructs: $10^{\wedge}10$ vp of CV-32ΔE1-gag; or $10^{\wedge}10$ vp CV33ΔE1-gag; or $10^{\wedge}10$ vp and $10^{\wedge}8$ vp MRKAd5ΔE1gag. PBMCs collected at regular 4-wks intervals were analyzed in an ELISPOT assay. The results provided in Table 6, which indicate the number of spot-forming cells per million PBMC following incubation in absence (mock) or presence of Gag peptide pool establish that both CV32ΔE1-gag and CV-33αE1-gag are able to induce significant levels of gag-specific T cells in non-human primates. It is interesting to note that after a single dose (wk 4), the CV32ΔE1-gag responses were comparable to MRKAd5 ΔE1-gag $10^{\wedge}8$ vp dose and lower than that of MRKAd5-gag $10^{\wedge}10$ vp/dose. CV33ΔE1-gag $10^{\wedge}10$ vp/dose induces a response comparable to that of MRKAd5-gag $10^{\wedge}10$ vp/dose. This result was confirmed at week 8 after the second dose.

TABLE 6

Gag-Specific T Cell Response in Monkeys Immunized with Mrkad5 ΔE1-Gag, CV32ΔE1-Gag, CV33ΔE1-Gag

| Vaccination T = 0 | vector dose | Monk # | Pre-bleed Mock | Pre-bleed Gag | T = 4 Mock | T = 4 Gag | T = 8 Mock | T = 8 Gag |
|---|---|---|---|---|---|---|---|---|
| CV32ΔE1gag | 10^10 vp | 01C023 | 1 | 0 | 14 | 353 | 3 | 278 |
|  |  | 01C029 | 1 | 3 | 13 | 605 | 3 | 419 |
|  |  | 01C032 | 1 | 0 | 5 | 274 | 1 | 179 |
| CV33ΔE1gag | 10^10 vp | 01C033 | 0 | 0 | 9 | 1545 | 1 | 659 |
|  |  | 01C036 | 4 | 5 | 4 | 1540 | 13 | 881 |
|  |  | 01D303 | 0 | 3 | 19 | 949 | 10 | 628 |
| MRKAd5gag | 10^8 vp | 01D267 | 0 | 0 | 4 | 473 | 0 | 341 |
|  |  | 01D279 | 1 | 4 | 44 | 831 | 6 | 336 |
|  |  | 01D284 | 4 | 5 | 4 | 264 | 5 | 129 |
| MRKAd5gag | 10^10 vp | 99C218 | 0 | 3 | 5 | 2500 | 0 | 1580 |
|  |  | 99C227 | 6 | 1 | 4 | 529 | 5 | 365 |
|  |  | 99D185 | ND | ND | 0 | 425 | 0 | 310 |

EXAMPLE 11

ChAd Vectors Elicit a HCV NS-Specific T-Cell Response in a Heterologous Prime-Boost Regimen In a separate experiment, groups of two and three monkey were given immunization at week 0, 4 of MRK Ad6NSoptmut vector at 10^8 or 10^10 vp per animal. The animals Were' boosted with the same virus at the same dose at week 24 and then boosted again at week 104 with CV33-NSmut at 10^10 vp per animal. The results are presented in Tables 7 and 8 which summarize the number of spot-forming cells per million PBMC following incubation in absence (mock) or presence of HCV NS peptide pool.

T cell immunity, as assessed by IFN-γ ELISPOT, showed a peak response at week 4 after the first dose in the animals injected with 10^10 vp (Table 8) and at week 8 (post-dose 2) in the animals injected at 10^8 (Table 7). The response was not boosted by the injection at week 24 ("homologous boost"), while a strong boost effect was observed after the injection with CV33-NSmut ("heterologous boost").

TABLE 7

HCV NS-Specific T Cell Response in Monkeys Immunized with MRK Ad6NSoptmut At 10^8 Vp/Animal and Boosted with CV33-Nsmut

| Vaccine | MRKAd6NSoptmut 10^8 vp | | | | | | | | CV33-NSmut 10^10 vp | | | |
|---|---|---|---|---|---|---|---|---|---|---|---|---|
| time point | post-priming I dose T = 4 | | post-priming II dose T = 8 | | pre-homologous boost T = 24 | | post-homologous boost T = 28 | | pre-heterologous boost T = 104 | | post-heterologous boost T = 108 | |
| monkey | 95116 | 138T | 95116 | 138T | 95116 | 138T | 95116 | 138T | 95116 | 138T | 95116 | 138T |
| poolF | 44 | 112 | 77 | 124 | 115 | 176 | 105 | 55 | 120 | 150 | 188 | 2228 |
| poolG | 20 | 2110 | 86 | 1975 | 201 | 1105 | 94 | 884 | 120 | 192 | 96 | 4590 |
| poolH | 12 | 18 | 54 | 22 | 169 | 221 | 28 | 9 | 81 | 33 | 447 | 543 |
| poolI | 14 | 53 | 62 | 47 | 163 | 189 | 96 | 18 | 80 | 67 | 71 | 515 |
| poolL | 33 | 86 | 58 | 44 | 353 | 608 | 235 | 33 | 110 | 131 | 224 | 308 |
| poolM | 184 | 75 | 168 | 138 | 204 | 336 | 67 | 44 | 55 | 46 | 2028 | 1570 |
| DMSO | 14 | 3 | 44 | 7 | 104 | 79 | 33 | 6 | 57 | 40 | 33 | 65 |

TABLE 8

HCV NS-Specific T Cell Response In Monkeys Immunized MRK Ad6NSoptmut At And 10^10 vp/Animal And Boosted With CV33-Nsmut

| Vaccine | MRKAd6NSoptmut 10^10 vp | | | | | | | | | | | |
|---|---|---|---|---|---|---|---|---|---|---|---|---|
| time point | post-priming I dose T = 4 | | | post-priming II dose T = 8 | | | pre-homologous boost T = 24 | | | post-homologous boost T = 28 | | |
| monkey | 98D209 | 106Q | 113Q | 98D209 | 106Q | 113Q | 98D209 | 106Q | 113Q | 98D209 | 106Q | 113Q |
| poolF | 3110 | 263 | 404 | 1340 | 300 | 723 | 678 | 61 | 583 | 321 | 123 | 1438 |
| poolG | 2115 | 642 | 1008 | 1070 | 316 | 2205 | 685 | 71 | 701 | 251 | 178 | 1758 |
| poolH | 373 | 72 | 19 | 358 | 43 | 43 | 424 | 24 | 42 | 51 | 23 | 18 |
| poolI | 103 | 37 | 347 | 80 | 36 | 531 | 237 | 39 | 169 | 12 | 35 | 485 |
| poolL | 149 | 22 | 10 | 93 | 36 | 29 | 279 | 46 | 48 | 11 | 49 | 51 |
| poolM | 314 | 428 | 19 | 153 | 243 | 20 | 333 | 81 | 38 | 38 | 134 | 11 |
| DMSO | 0 | 1 | 3 | 16 | 16 | 5 | 128 | 8 | 9 | 8 | 10 | 16 |

TABLE 8-continued

HCV NS-Specific T Cell Response In Monkeys Immunized MRK Ad6NSoptmut
At And 10^10 vp/Animal And Boosted With CV33-Nsmut

| Vaccine | CV33-NSmut 10^10 | | | | | |
|---|---|---|---|---|---|---|
| time point | pre-heterologous boost T = 104 | | | post-heterologous boost T = 108 | | |
| monkey | 98D209 | 106Q | 113Q | 98D209 | 106Q | 113Q |
| poolF | 204 | 192 | 326 | 1581 | 1525 | 1714 |
| poolG | 166 | 106 | 625 | 1118 | 524 | 4238 |
| poolH | 92 | 45 | 55 | 413 | 58 | 211 |
| poolI | 66 | 79 | 376 | 459 | 85 | 2738 |
| poolL | 89 | 109 | 73 | 199 | 76 | 431 |
| poolM | 41 | 81 | 9 | 228 | 1440 | 227 |
| DMSO | 20 | 51 | 12 | 18 | 13 | 5 |

The efficiency of heterologous boost with chimp Ad vectors was evaluated in a second experiment. Cohorts of three monkeys were immunized at week 0 and week 4 with MRKAd5gag (10^10 vp/animal), MRKAd6NSmut (10^10 vp/animal) or with the combination of both vectors (10^10 vp/animal each vector) then boosted with the same immunogen at week 24 (homologous boost). Homologous boost was performed with the same immunogens; heterologous boost was performed with CV33gag, CV32 NSmut or with the two vectors in combination. The results provided in Table 9 summarize the number of spot-forming cells per million PBMC following incubation in absence (mock) or presence of HCV NS peptide pool.

The same cohorts were boosted again at week 51 with CV33gag (10^10 vp/animal), CV32NSmut (10^10 vp/animal) and with the combination of the two vectors (10^10 vp/animal each vector). The results provided in Table 9 further indicate that the homologous boost was not efficient since the responses are below the peak observed at week 4 after the injection of the first dose of vaccine. A strong boosting effect was measured by IFN-γ ELISPOT at week 54 after immunization with heterologous chimp vectors.

TABLE 9

Immunization with Chimp Ad vectors efficiently boost Gag and HCV NS-specific T cell response
in monkeys immunized with MRK Ad5gag or MRK Ad6NSoptmut at 10^10 vp/animal

| Vaccine | MRKAd5gag | | | | | | | | |
|---|---|---|---|---|---|---|---|---|---|
| Time point | post-dose 1 (T = 4) | | | post-dose 2 (T = 8) | | | pre-homol. boost (T = 24) | | |
| animal ID | 00D105 | 00D076 | 00D299 | 00D105 | 00D076 | 00D299 | 00D105 | 00D076 | 00D299 |
| poolF | 18 | 35 | 60 | 16 | 29 | 14 | 37 | 76 | 40 |
| poolG | 16 | 23 | 49 | 4 | 28 | 31 | 54 | 95 | 106 |
| poolH | 45 | 51 | 57 | 18 | 31 | 42 | 55 | 88 | 55 |
| poolI | 21 | 21 | 48 | 4 | 26 | 11 | 19 | 54 | 26 |
| poolL | 15 | 21 | 58 | 9 | 31 | 20 | 71 | 183 | 128 |
| poolM | 39 | 24 | 49 | 26 | 14 | 49 | 38 | 93 | 39 |
| Gag | 1764 | 2208 | 2762 | 574 | 1906 | 1959 | 391 | 935 | 702 |
| DMSO | 9 | 13 | 37 | 7 | 14 | 13 | 16 | 76 | 33 |

| Vaccine | MRKAd5gag | | | CV33gag | | | | | |
|---|---|---|---|---|---|---|---|---|---|
| Time point | post-homol. boost (T = 28) | | | pre-heterol. boost (T = 51) | | | post-heterol. boost (T = 54) | | |
| animal ID | 00D105 | 00D076 | 00D299 | 00D105 | 00D076 | 00D299 | 00D105 | 00D076 | 00D299 |
| poolF | 37 | 8 | 14 | 37 | 27 | 44 | 43 | 44 | 70 |
| poolG | 81 | 2 | 46 | 36 | 27 | 37 | 84 | 108 | 109 |
| poolH | 47 | 11 | 32 | 69 | 36 | 60 | 85 | 58 | 120 |
| poolI | 38 | 6 | 6 | 22 | 11 | 32 | 33 | 26 | 24 |
| poolL | 106 | 6 | 27 | 61 | 21 | 65 | 28 | 45 | 44 |
| poolM | 59 | 6 | 19 | 62 | 23 | 38 | 27 | 19 | 14 |
| Gag | 2123 | 336 | 736 | 485 | 833 | 1384 | 4003 | 4333 | 3863 |
| DMSO | 26 | 3 | 11 | 28 | 19 | 39 | 23 | 16 | 53 |

TABLE 9-continued

Immunization with Chimp Ad vectors efficiently boost Gag and HCV NS-specific T cell response in monkeys immunized with MRK Ad5gag or MRK Ad6NSoptmut at 10^10 vp/animal

| Vaccine | MRK Ad5gag + MRKAd6NSmut | | | | | | | | |
|---|---|---|---|---|---|---|---|---|---|
| time point | post-dose 1 (T = 4) | | | post-dose 2 (T = 8) | | | pre-homol. boost (T = 24) | | |
| animal ID | 00D088 | 00D099 | 00D240 | 00D088 | 00D099 | 00D240 | 00D088 | 00D099 | 00D240 |
| poolF | 438 | 118 | 105 | 720 | 116 | 154 | 206 | 108 | 242 |
| poolG | 21 | 784 | 1483 | 44 | 362 | 940 | 19 | 234 | 548 |
| poolH | 24 | 53 | 8 | 46 | 27 | 19 | 13 | 66 | 93 |
| poolI | 83 | 28 | 9 | 90 | 24 | 8 | 16 | 40 | 68 |
| poolL | 13 | 14 | 13 | 16 | 17 | 9 | 28 | 101 | 140 |
| poolM | 39 | 31 | 6 | 101 | 27 | 16 | 21 | 73 | 107 |
| Gag | 2138 | 1044 | 1063 | 2260 | 505 | 819 | 454 | 241 | 456 |
| DMSO | 5 | 6 | 3 | 8 | 5 | 1 | 10 | 18 | 43 |

| Vaccine | MRK Ad5gag + MRKAd6NSmut | | | CV33gag + CV32NSmut | | | | | |
|---|---|---|---|---|---|---|---|---|---|
| time point | post-homol. boost (T = 28) | | | pre-heterol. boost (T = 51) | | | post-heterol. boost (T = 54) | | |
| animal ID | 00D088 | 00D099 | 00D240 | 00D088 | 00D099 | 00D240 | 00D088 | 00D099 | 00D240 |
| poolF | 408 | 99 | 219 | 778 | 135 | 56 | 1701 | 1121 | 424 |
| poolG | 47 | 781 | 844 | 78 | 363 | 265 | 228 | 3180 | 2770 |
| poolH | 49 | 41 | 87 | 115 | 50 | 28 | 97 | 291 | 104 |
| poolI | 33 | 16 | 42 | 56 | 19 | 8 | 165 | 145 | 22 |
| poolL | 39 | 27 | 78 | 59 | 28 | 15 | 137 | 815 | 463 |
| poolM | 44 | 26 | 78 | 114 | 28 | 10 | 219 | 109 | 21 |
| Gag | 1100 | 368 | 716 | 1542 | 237 | 161 | 4460 | 2908 | 1764 |
| DMSO | 9 | 13 | 28 | 14 | 18 | 12 | 9 | 21 | 6 |

| Vaccine | MRKAd6 NSmut | | | | | | | | |
|---|---|---|---|---|---|---|---|---|---|
| time point | post-dose 1 (T = 4) | | | post-dose 2 (T = 8) | | | pre-homol. boost (T = 24) | | |
| animal ID | 00D065 | 00D116 | 00D159 | 00D065 | 00D116 | 00D159 | 00D065 | 00D116 | 00D159 |
| poolF | 139 | 44 | 82 | 92 | 121 | 63 | 62 | 116 | 54 |
| poolG | 154 | 253 | 119 | 77 | 156 | 108 | 93 | 165 | 126 |
| poolH | 1284 | 41 | 211 | 768 | 35 | 124 | 394 | 84 | 77 |
| poolI | 302 | 22 | 1174 | 221 | 16 | 1069 | 134 | 31 | 561 |
| poolL | 28 | 16 | 48 | 35 | 32 | 21 | 141 | 113 | 78 |
| poolM | 1329 | 1007 | 36 | 579 | 392 | 30 | 314 | 293 | 43 |
| Gag | 15 | 9 | 7 | 13 | 5 | 2 | 36 | 33 | 36 |
| DMSO | 16 | 4 | 5 | 9 | 6 | 4 | 23 | 17 | 8 |

| Vaccine | MRKAd6 NSmut | | | CV32NSmut | | | | | |
|---|---|---|---|---|---|---|---|---|---|
| time point | post-homol. boost (T = 28) | | | pre-heterol. boost (T = 51) | | | post-heterol. boost (T = 54) | | |
| animal ID | 00D065 | 00D116 | 00D159 | 00D065 | 00D116 | 00D159 | 00D065 | 00D116 | 00D159 |
| poolF | 44 | 42 | 23 | 57 | 85 | 53 | 313 | 385 | 261 |
| poolG | 104 | 59 | 39 | 44 | 198 | 48 | 196 | 764 | 559 |
| poolH | 24 | 817 | 48 | 624 | 31 | 116 | 3758 | 90 | 925 |
| poolI | 18 | 133 | 478 | 84 | 16 | 362 | 485 | 51 | 2951 |
| poolL | 19 | 48 | 17 | 46 | 33 | 46 | 379 | 339 | 541 |
| poolM | 558 | 398 | 22 | 159 | 369 | 33 | 1278 | 1750 | 16 |
| Gag | 9 | 23 | 14 | 16 | 8 | 10 | 37 | 9 | 26 |
| DMSO | 1 | 9 | 3 | 23 | 8 | 6 | 26 | 9 | 10 |

EXAMPLE 12

Vaccination with a ChAd Vector Comprising a TAA Breaks Tolerance and Elicits a TAA-Specific T Cell Response in Monkeys Experiments designed to determine whether chimpanzee adenoviral vectors are sufficiently immunogenic to break the tolerance to a self-antigen and to document the utility of chimpanzee vectors for boosting an immune response primed with a human adenoviral vector were performed in cohorts of four monkeys. Animals were immunized with three injection at week 0, 2 and 4 of Ad5DE1 RhCEA ($10^{11}$ vp), comprising the tumor associated antigen CEA, followed by vaccination at week 16, 18 and 20 with CV33DE1 RhCEA ($10^{11}$ vp). T cell response was measured by IFNγ ELISPOT with rhesus CEA peptides.

Figure 34:
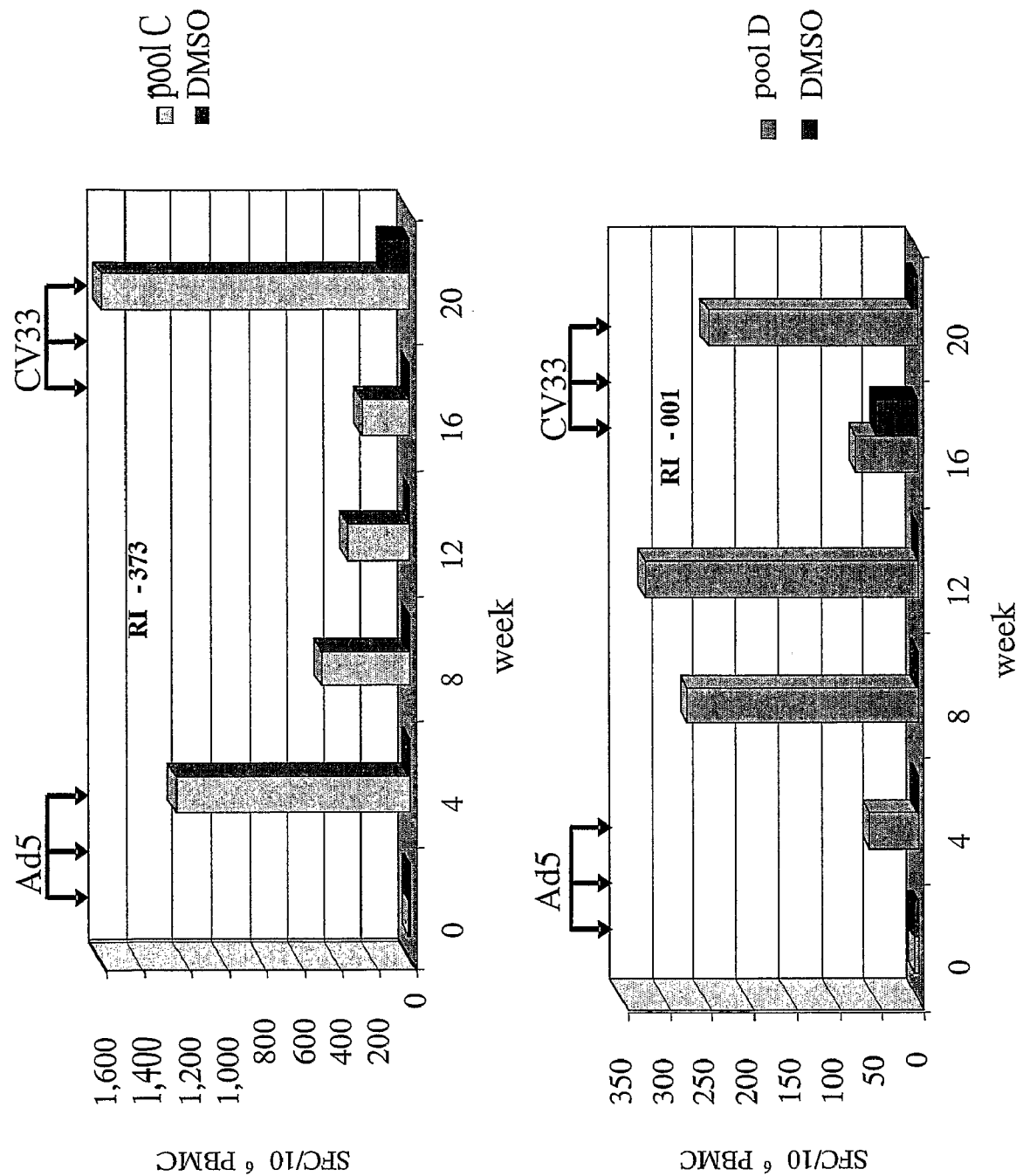
FIG. 34 provides a graphic representation of a CEA-specific T cell response elicited in rhesus macaques immunized sequentially with a human adenoviral vector (MRKAd5 RhCEA) followed by a chimpanzee adenoviral vector (CV33 RhCEA) after 12 week interval. The immune responses were evaluated by IFN-γ ELISPOT assay, and the data illustrate the number of spot-forming cells (SFC) per million peripheral blood mononuclear cells (PBMC) following incubation in the absence (DMSO) and presence of rhesus CEA C and D peptide pools.

The results reported in FIG. 34, which provide the number of spot-forming cells per million PBMC following incubation in absence (DMSO) or in presence of rhesus CEA C and D peptides pools, establish that an immunization protocol based on vaccination with two different Ad serotypes leads to a sustained T cell response against CEA in non-human primates.

While the invention has been described in detail with reference to certain preferred embodiments thereof, it will be understood that modifications and variations are within the spirit and scope of that which is described and claimed.

SEQUENCE LISTING (125 sequences)

SEQ ID NO: 1 - DNA, 37741 bp, Chimpanzee Adenovirus- ChAd3 Genomic
catcatcaataatataccttattttggattgaagccaatatgataatgagatgggcggcgcgaggcggggcgcggggcgggaggcgggtttgggggcgggccggcgggcggggcggtgtggcggaagtggactttgtaagtgtggcggatgtgacttgctagtgccgggcgcggtaaaagtgacgttttccgtgcgcgacaacgcccccgggaagtgacatttttcccgcggtttttaccggatgttgtagtgaatttgggcgtaaccaagtaagatttggccattttcgcgggaaaactgaaacggggaagtgaaatctgattaattttgcgttagtcataccgcgtaatatttgtctagggccgagggactttggccgattacgtggaggactcgcccaggtgttttttgaggtgaatttccgcgttccgggtcaaagtctccgttttattattatagtcagctgacgcggagtgtatttataccctctgatctcgtcaagaggccactcttgagtgccagcgagtagagttttctcctctgccgctctccgctccgctccgctcggctctgacaccggggaaaaaatgagacatttcacctacgatggcggtgtgctcaccggccagctggctgctgaggtcctggacaccctgatcgaggaggtattggccgataattatcctccctcgactccttttgagccacctacacttcacgaactatacgatctggatgtggtggggcccagcgatccgaacgagcaggcggtttccagtttttttccagagtccatgttgttggccagccaggagggggtcgaacttgagacccctcctccgatcgtggattcccccgatccgccgcagctgactaggcagcccgagcgctgtgcgggacctgagactatgccccagctgctacctgaggtgatcgatctcacctgtaatgagtctggttttccacccagcgaggatgaggacgaagagggtgagcagtttgtgttagattctgtggaacaacccgggcgaggatgcaggtcttgtcaatatcaccggaaaaacacaggagactcccagattatgtgttctctgtgttatatgaagatgacctgtatgtttatttacagtaagtttatcatcggtgggcaggtgggctatagtgtgggtggtggtctttggggggttttttaatatatgtcaggggttatgctgaagacttttttattgtgatttttaaaggtccagtgtctgagcccgagcaagaacctgaaccggagcctgagccttctcgccccaggagaaagcctgtaatcttaactagacccagcgcaccggtagcgagaggcctcagcagcgcggagaccaccgactccggtgcttcctcatcacccccggagattcaccccctggtgcccctatgtcccgttaagcccgttgccgtgagagtcagtgggcggcggtctgctgtggagtgcattgaggacttgctttttgattcacaggaacctttggacttgagcttgaaacgccccaggcattaaacctggtcacctggactgaatgagttgacgcctatgtttgcttttgaatgacttaatgtgtatagataataaagagtgagataatgttttaattgcatggtgtgtttaacttgggcggagtctgctgggtatataagcttccctgggctaaacttggttacacttgacctcatggaggcctgggagtgtttggagaactttgccggagttcgtgccttgctggacgagagctctaacaatacctcttggtggtggaggtatttgtggggctctccccagggcaagttagtttgtagaatcaaggaggattacaagtgggaatttgaagagcttttgaaatcctgtggtgagctattggattctttgaatctaggccaccaggctctcttccaggagaaggtcatcaggactttggatttttccacaccggggcgcattgcagccgcggttgcttttctagcttttttgaaggatagatggagcgaagagacccacttgagttcgggctacgtcctggattttctggccatgcaactgtggagagcatggatcagacacaagaacaggctgcaactgttgtcttccgtccgcccgttgctgattccggcggaggagcaacaggccgggtcagaggaccgggcccgtcgggatccggaggagagggcaccgaggccgggcgagaggagcgcgctgaacctgggaaccgggctgagcggccatccacatcgggagtgaatgtcgggcaggtggtggatctttttccagaactgcggcggattttgactattagggaggatgggcaatttgttaagggtcttaagagggagaggggggcttctgagcataacgaggaggccagtaatttagcttttagcttgatgaccagacaccgtccagagtgcatcacttttcagcagattaaggacaattgtgccaatgagttggatctgttgggtcagaagtatagcatagagcagctgaccacttactggctgcagccgggtgatgatctggaggaagctattagggtgtatgctaaggtggccctgcggcccgattgcaagtacaagctcaaggggctggtgaatatcaggaattgttgctacatttctggcaacggggcggaggtggagatagagaccgaagacagggtggctttcagatgcagcatgatgaatatgtggccgggggtgctgggcatggacggggtggtgattatgaatgtgaggttcacggggcccaactttaacggcacggtgtttttggggaacaccaacctggtcctgcacggggtgagcttctatgggtttaacaacacctgtgtggaggcctggaccgatgtgaaggtccgcggttgcgccttttatggatgttggaaggccatagtgagccgccctaagagcaggagttccattaagaaatgcttgtttgagaggtgcaccttggggatcctggccgagggcaactgcagggtgcgccacaatgtggcctccgagtgcggttgcttcatgctagtcaagagcgtggcggtaatcaagcataatatggtgtgcggcaacagcgaggacaaggcctcacagatgctgacctgcacggatggcaactgccacttgctgaagaccatccatgtaaccagccacagccggaaggcctggcccgtgttcgagcacaacttgctgacccgctgctccttgcatctgggcaacaggcggggggtgttcctgccctatcaatgcaactttagtcacaccaagatcttgctagagcccgagagcatgtccaaggtgaacttgaacggggtgtttgacatgaccatgaagatctggaaggtgctgaggtacgacgagaccaggtcccggtgcagaccctgcgagtgcgggggcaagcatatgaggaaccagcccgtgatgctggatgtgaccgaggagctgaggacagaccacttggttctggcctgcaccagggccgagtttggttctagcgatgaagacacagattgaggtgggtgagtgggcgtggcctggggtggtcatgaaaatatataagttgggggtcttagggtctctttatttgtgttgcagagaccgccggagccatgagcgggagcagcagcagcagcagtagcagcagcgccttggatggcagcatcgtgagcccttatttgacgacgcggatgccccactgggccggggtgcgtcagaatgtgatgggctccagcatcgacggccgacccgtcctgcccgcaaattccgccacgctgacctatgcgaccgtcgcggggacgccgttggacgccaccgccgccgccgccgccaccgcagccgcctcggccgtgcgcagcctggccacggactttgcattcctgggaccactggcgacaggggctacttctcgggccgctgctgccgccgttcgcgatgacaagctgaccgccctgctggcgcagttggatgcgcttactcgggaactgggtgacctttctcagcaggtcatggccctgcgccagcaggtctcctccctgcaagctggcgggaatgcttctcccacaaatgccgtttaagataaataaaaccagactctgtttggattaaagaaaagtagcaagtgcattgctctctttatttcataattttccgcgcgcgataggccctagaccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttcagcagcaggccgatggccagggggaggcccttggtgtaagtgtttacaaaacggttaagttgggaagggtgcattcggggagagatgatgtgcatcttggactgtatttttagattggcgatgtttccgcccagatcccttctgggattcatgttgtgcaggaccaccagtacagtgtatccggtgcacttggggaatttgtcatgcagcttagagggaaaagcgtggaagaacttggagacgcccttgtggcctcccagattttccatgcattcgtccatgatgatggcaatgggcccgcgggaggcagcttgggcaaagatatttctggggtcgctgacgtcgtagttgtgttccagggtgaggtcgtcataggccatttttacaaagcgcgggcggagggtgcccgactgggggatgatggtcccctctggccctggggcgtagttgccctcgcagatctgcatttcccaggccttaatctcggaggggggaatcatatccacctgcggggcgatgaagaaaacggtttccggagccggggagattaactgggatgagagcaggtttctaagcagctgtgattttccacaaccggtgggcccataaataacacctataaccggttgcagctggtagtttagagagctgcagctgccgtcgtcccggaggaggggggccacctcgttgagcatgtccctgacgcgcatgttctccccgaccagatccgccagaaggcgctcgccgcccagggacagcagctcttgcaaggaagcaaagtttttcagcggcttgaggccgtccgccgtgggcatgtttttcagggtctggctcagcagctccaggcggtcccagagctcggtgacgtgctctacggcatctctatccagcatatctcctcgtttcgcgggttggggcgactttcgctgtagggcaccaagcggtggtcgtccagcggggccaaagtcatgtccttccatgggcgcagggtcctcgtcagggtggtctgggtcacggtgaaggggtgcgctccgggctgagcgcttgccaaggtgcgcttgaggctggttctgctggtgctgaagcgctgccggtcttcgccctgcgcgtcggccaggtagcatttgaccatggtgtcatagtccagcccctccgcggcgtgtcccttggcgcgcagcttgcccttggaggtggcgccgcacgaggggcagagcaggctcttgagcgcgtagagcttgggggcgaggaagaccgattcgggggagtaggcgtccgcgccgcagaccccgcacacggtctcgcactccaccagccaggtgagctcggggcgcgccgggtcaaaaaccaggtttcccccatgctttttgatgcgtttcttacctcgggtctccatgaggtggtgtccccgctcggtgacgaagaggctgtccgtgtctccgtagaccgacttgaggggtcttttctccaggggggtccctcggtcttcctcgtagaggaactcggaccactctgagacgaaggcccgcgtccaggccaggacgaaggaggctatgtgggaggggtagcggtcgttgtccactagggggtccaccttctccaaggtgtgaagacacatgtcgccttcctcggcgtccaggaaggtgattggcttgtaggtgtaggccacgtgaccgggggttcctgacgggggggtataaaagggggtgggggcgcgctcgtcgtcactctcttccgcatcgctgtctgcgagggccagctgctggggtgagtattccctctcgaaggcgggcatgacctccgcgctgaggttgtcagtttccaaaaacgaggaggatttgatgttcacctgtcccgaggtgatacctttgagggtacccgcgtccatctggtcagaaaacacgatctttttattgtccagcttggtggcgaacgacccgtagagggcgttggagagcagcttggcgatggagcgcagggtctggttcttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgaccaggtccacgctggtggcgacctcgccgcgcaggcgctcgttggtccagcagagacggccgcccttgcgcgagcagaaggggggcagggggtcgagctgggtctcgtccggggggtccgcgtccacggtgaaaaccccggggcgcaggcgcgcgtcgaagtagtctatcttgcaaccttgcatgtccagcgcctgctgccagtcgcgggcggcgagcgcgcgctcgtaggggttgagcggcgggccccagggcatggggtgggtgagtgcggaggcgtacatgccgcagatgtcatagacgtagaggggctcccgcaggaccccgatgtaggtggggtagcagcggccgccgcggatgctggcgcgcacgtagtcatacagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggagtcgcgcagcttgtgtaccagctcggcggtgacctgcacgtcgagcgcgcagtagtcgagggtctcgcggatgatgtcatatttagcctgccccttctttttccacagctcgcggttgaggacaaactcttcgcggtctttccagtactcttggatcgggaaaccgtccggttccgaacggtaagagcctagcatgtagaactggttgacggcctggtaggcgcagcagcccttctccacggggagggcgtaggcctgcgcggccttgcggagcgaggtgtgggtcagggcgaaggtgtccctgaccatgactttgaggtactggtgcttgaagtcggagtcgtcgcagccgccccgctcccagagcgagaagtcggtgcgcttcttggagcgggggttgggcagagcgaaggtgacatcgttgaagaggattttgcccgcgcggggcatgaagttgcgggtgatgcggaagggccccggcacttcagagcggttgttgatgacctgggcggcgagcacgatctcgtcgaagccgttgatgttgtggcccacgatgtagagttccaggaagcggggccggccctttacggtgggcagcttctttagctcttcgtaggtgagctcctcgggcgaggcgaggccgtgctcggccagggcccagtccgcgaggtgcgggttgtctctgaggaaggactcccagaggtcgcgggccaggagggtctgcaggcggtccctgaaggtcctgaactggcggcccacggccattttttcgggggtgatgcagtagaaggtgagggggtcttgctgccagcggtcccagtcgagctgcagggcgaggtcgcgcgcggcggtgaccaggcgctcgtcgcccccgaatttcatgaccagcatgaagggcacgagctgctttccgaaggcccccatccaagtgtaggtctctacatcgtaggtgacaaagaggcgctccgtgcgaggatgcgagccgatcgggaagaactggatctcccgccaccagttggaggagtggctgttgatgtggtggaagtagaagtcccgtcgccgggccgaacactcgtgctggcttttgtaaaagcgagcgcagtactggcagcgctgcacgggctgtacctcctgcacgagatgcacctttcgcccgcgcacgaggaagccgaggggaaatctgagccccccgcctggctcgcggcatggctggtgctcttctactttggatgcgtgtccgtctccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggttcacctcgcagagtcgggccagggcgcggggcaggtctaggtggtacctgatctctaggggcgtgttggtggcggcgtcgatggcttgcaggagcccgcatccccggggggcgacgacggtgccccgcggggtggtggtggtggtggtggtggtggtggtggcggtgcagctcagaagcggtgccgcgggcgggcccccggaggtagggggggctccggtcccgccggcaggggcggcagcggcacgtcggcgtggagcgcgggcaggagttggtgctgtgcccggaggttgctggcgaaggcgacgacgcggcggttgatctcctggatctggcgcctctgcgtgaagacgacgggcccggtgagcttgaacctgaaagagagttcgacagaatcaatctcggtgtcattgaccgcggcctggcgcaggatctcctgcacgtctcccgagttgtcttggtaggcgatctcggccatgaactgctcgatctcttcctcctggaggtctccgcgtccggcgcgttccacggtggccgccaggtcgttggagatgcgccccatgagctgcgagaaggcgttgagtccgccctcgttccagactcggctgtagaccacgcccccctggtcatcgcgggcgcgcatgaccacctgcgcgaggttgagctccacgtgccgcgcgaagacggcgtagttgcgcagacgctggaagaggtagttgagggtggtggcggtgtgctcggccacgaagaagttcatgacccagcggcgcaacgtggattcgttgatgtcccccaaggcctccagccgttccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgctagcatcaccacctcctcctcttcctcctcttctggcacttccatgatggcttcctcctcttcggggggcggcggcggcggcggtgggggagggggcgctctgcgccggcggcggcgcaccgggaggcggtccacgaagcgcgcgatcatctccccgcggcggcggcgcatggtctcggtgacggcgcggccgttctcccgggggcgcagttggaagacgccgccggacatctggtgctggggcgggtggccgtgaggcagcgaaacggcgctgacgatgcatctcaacaattgctgcgtaggtacgccgccgagggacctgagggagtccatatccaccggatccgaaaacctttcgaggaaggcgtctaaccagtcgcagtcgcaaggtaggctgagcaccgtggcgggcggcggggggtggggggagtgtctggcggaggtgctgctgatgatgtaattgaagtaggcggacttgacacggcggatggtcgacaggagcaccatgtccttgggtccggcctgctggatgcggaggcggtcggctatgccccaggcttcgttctggcatcggcgcaggtccttgtagtagtcttgcatgagcctttccaccggcacctcttctccttcctcttctgcttcttccatgtctgcttcggccctggggcggcgccgcgcccccctgccccccatgcgcgtgaccccgaaccccctgagcggttggagcagggccaggtcggcgacgacgcgctcggccaggatggcctgctgcacctgcgtgagggtggtttggaagtcatccaagtccacgaagcggtggtaggcgcccgtgttgatggtgtaggtgcagttggccatgacggaccagttgacggtctggtggcccggttgcgacatctcggtgtacctgagtcgcgagtaggcgcgggagtcgaagacgtagtcgttgcaagtccgcaccaggtactggtagcccaccaggaagtgcggcggcggctggcggtagaggggccagcgcagggtggcgggggctccgggggccaggtcttccagcatgaggcggtggtaggcgtagatgtacctggacatccaggtgatacccgcggcggtggtggaggcgcgcgggaagtcgcgcacccggttccagatgttgcgcaggggcagaaagtgctccatggtaggcgtgctctgtccagtcagacgcgcgcagtcgttgatactctagaccagggaaaacgaaagccggtcagcgggcactcttccgtggtctggtgaatagatcgcaagggtatcatggcggagggcctcggttcgagccccgggtccgggccggacggtccgccatgatccacgcggttaccgcccgcgtgtcgaacccaggtgtgcgacgtcagacaacggtggagtgttccttttggcgtttttctggccgggcgccggcgtcgcgtaagagactaagccgcgaaagcgaaagcagtaagtggctcgctccccgtagccggagggatccttgctaagggttgcgttgcggcgaaccccggttcgaatcccgtactcgggccggccggacccgcggctaaggtgttggattggcctccccctcgtataaagaccccgcttgcggattgactccggacacggggacgagccccttttatttttgctttccccagatgcatccggtgctgcggcagatgcgccccccgccccagcagcagcaacaacaccagcaagagcggcagcaacagcagcgggagtcatgcagggccccctcacccaccctcggcgggccggccacctcggcgtccgcggccgtgtctggcgcctgcggcggcggcggggggccggctgacgaccccgaggagcccccgcggcgcagggccagacactacctggacctggaggagggcgagggcctggcgcggctgggggcgccgtctcccgagcgccacccgcgggtgcagctgaagcgcgactcgcgcgaggcgtacgtgcctcggcagaacctgttcagggaccgcgcgggcgaggagcccgaggagatgcgggacaggaggttcagcgcagggcgggagctgcggcaggggctgaaccgcgagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaagagtttcaacaaccacgtgcgcacgctggtggcgcgcgaggaggtgaccatcgggctgatgcacctgtgggactttgtaagcgcgctggtgcagaaccccaacagcaagcctctgacggcgcagctgttcctgatagtgcagcacagcagggacaacgaggcgtttagggacgcgctgctgaacatcaccgagcccgagggtcggtggctgctggacctgattaacatcctgcagagcatagtggtgcaggagcgcagcctgagcctggccgacaaggtggcggccatcaactactcgatgctgagcctgggcaagttttacgcgcgcaagatctaccagacgccgtacgtgcccatagacaaggaggtgaagatcgacggtttttacatgcgcatggcgctgaaggtgctcaccctgagcgacgacctgggcgtgtaccgcaacgagcgcatccacaaggccgtgagcgtgagccggcggcgcgagctgagcgaccgcgagctgatgcacagcctgcagcgggcgctggcgggcgccggcagcggcgacagggaggcggagtcctacttcgatgcgggggcggacctgcgctgggcgcccagccggcgggccctggaggccgcgggggtccgcgaggactatgacgaggacggcgaggaggatgaggagtacgagctagaggagggcgagtacctggactaaaccgcgggtggtgtttccggtagatgcaagacccgaacgtggtggacccggcgctgcgggcggctctgcagagccagccgtccggccttaactcctcagacgactggcgacaggtcatggaccgcatcatgtcgctgacggcgcgtaacccggacgcgttccggcagcagccgcaggccaacaggctctccgccatcctggaggcggtggtgcctgcgcgctcgaaccccacgcacgagaaggtgctggccatagtgaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgcgagcgcgcggatcggcagggcaacctgggctccatggtggcgctgaatgccttcctgagcacgcagccggccaacgtgccgcgggggcaggaagactacaccaactttgtgagcgcgctgcggctgatggtgaccgagaccccccagagcgaggtgtaccagtcgggcccggactacttcttccagaccagcagacagggcctgcagacggtgaacctgagccaggctttcaagaacctgcgggggctgtggggcgtgaaggcgcccaccggcgaccgggcgacggtgtccagcctgctgacgcccaactcgcgcctgctgctgctgctgatcgcgccgttcacggacagcggcagcgtgtcccgggacacctacctggggcacctgctgaccctgtaccgcgaggccatcgggcaggcgcaggtggacgagcacaccttccaggagatcaccagcgtgagccgcgcgctggggcaggaggacacgagcagcctggaggcgactctgaactacctgctgaccaaccggcggcagaagattccctcgctgcacagcctgacctccgaggaggagcgcatcttgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacctgcatcgcgcggcggccgtgaaccccgagtactttaccaacgccatcctgaacccgcactggctcccgccgcccgggttctacagcgggggcttcgaggtcccggaggccaacgatggcttcctgtgggacgacatggacgacagcgtgttctccccgcggccgcaggcgctggcggaagcgtccctgctgcgtcccaagaaggaggaggaggaggcgagtcgccgccgcggcagcagcggcgtggcttctctgtccgagctgggggcggcagccgccgcgcgccccgggtccctgggcggcagcccctttccgagcctggtggggtctctgcacagcgagcgcaccacccgccctcggctgctgggcgaggacgagtacctgaataactccctgctgcagccggtgcgggagaaaaacctgccccccgccttccccaacaacgggatagagagcctggtggacaagatgagcagatggaagacctatgcgcaggagcacagggacgcgcccgcgctccggccgcccacgcggcgccagcgccacgaccggcagcgggggctggtgtgggatgacgaggactccgcggacgatagcagcgtgctggacctgggagggagcggcaacccgttcgcgcacctgcgcccccgcctggggaggatgttttaaaaaaaaaaaaagcaagaagcatgatgcaaaattaaataaaactcaccaaggccatggcgaccgagcgttggtttcttgtgttcccttcagtatgcggcgcgcggcgatgtaccaggagggacctcctccctcttacgagagcgtggtgggcgcggcggcggcggcgccctcttctccctttgcgtcgcagctgctggagccgccgtacgtgcctccgcgctacctgcggcctacgggggggagaaacagcatccgttactcggagctggcgcccctgttcgacaccacccgggtgtacctggtggacaacaagtcggcggacgtggcctccctgaactaccagaacgaccacagcaattttttgaccacggtcatccagaacaatgactacagcccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggaagaccgggtggagctgaagtacgagtgggtggagttcgagctgccagagggcaactactccgagaccatgaccattgacctgatgaacaacgcgatcgtggagcactatctgaaagtgggcaggcaaaacggggtcctggagagcgacatcggggtcaagttcgacaccaggaacttccgcctggggctggaccccgtgaccgggctggttatgcccggggtgtacaccaacgaggccttccatcccgacatcatcctgctgcccggctgcggggtggacttcacttacagccgcctgagcaacctcctgggcatccgcaagcggcagcccttccaggagggcttcaggatcacctacgaggacctggaggggggcaacatccccgcgctcctcgatgtggaggcctaccaggatagcttgaaggaaaatgaggcgggacaggaggataccacccccgccgcctccgccgccgccgagcagggcgaggatgctgctgacaccgcggccgcggacggggcagaggccgaccccgctatggtggtggaggctcccgagcaggaggaggatatgaatgacagtgcggtgcgcggagacaccttcgtcacccggggggaggaaaagcaagcggaggccgaggccgcggccgaggaaaagcaactggcggcagcagcggcggcggcggcgttggccgcggcggaggctgagtctgaggggaccaagcccgccaaggagcccgtgattaagcccctgaccgaagatagcaagaagcgcagttacaacctgctcaaggacagcaccaacaccgcgtaccgcagctggtacctggcctacaactacggcgacccgtcgacgggggtgcgctcctggaccctgctgtgcacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgttactgacgccagacgccgcacctgcccctacgtttacaaggccttgggcatagtctcgccgcgcgtcctttccagccgcactttttgagcaacaccaccatcatgtccatcctgatctcacccagcaataactccggctggggactgctgcgcgcgcccagcaagatgttcggaggggcgaggaagcgttccgagcagcaccccgtgcgcgtgcgcgggcacttccgcgccccctggggagcgcacaaacgcggccgcgcggggcgcaccaccgtggacgacgccatcgactcggtggtggagcaggcgcgcaactacaggcccgcggtctctaccgtggacgcggccatccagaccgtggtgcggggcgcgcggcggtacgccaagctgaagagccgccggaagcgcgtggcccgccgccaccgccgccgacccggggccgccgccaaacgcgccgccgcggccctgcttcgccgggccaagcgcacgggccgccgcgccgccatgagggccgcgcgccgcttggccgccggcatcaccgccgccaccatggccccccgtacccgaagacgcgcggccgccgccgccgccgccgccatcagtgacatggccagcaggcgccggggcaacgtgtactgggtgcgcgactcggtgaccggcacgcgcgtgcccgtgcgcttccgccccccgcggacttgagatgatgtgaaaaaacaacactgagtctcctgctgttgtgtgtatcccagcggcggcggcgcgcgcagcgtcatgtccaagcgcaaaatcaaagaagagatgctccaggtcgtcgcgccggagatctatgggcccccgaagaaggaagagcaggattcgaagccccgcaagataaagcgggtcaaaaagaaaaagaaagatgatgacgatgccgatggggaggtggagttcctgcgcgccacggcgcccaggcgcccggtgcagtggaagggccggcgcgtaaagcgcgtcctgcgccccggcaccgcggtggtcttcacgcccggcgagcgctccacccggactttcaagcgcgtctatgacgaggtgtacggcgacgaagacctgctggagcaggccaacgagcgcttcggagagtttgcttacgggaagcgtcagcgggcgctggggaaggaggacctgctggcgctgccgctggaccagggcaaccccacccccagtctgaagcccgtgaccctgcagcaggtgctgccgagcagcgcaccctccgaggcgaagcggggtctgaagcgcgagggcggcgacctggcgcccaccgtgcagctcatggtgcccaagcggcagaggctggaggatgtgctggagaaaatgaaagtagaccccggtctgcagccggacatcagggtccgtcccatcaagcaggtggcgccgggcctcggcgtgcagaccgtggacgtggtcatccccaccggcaactcccccgccgccaccaccactaccgctgcctccacggacatggagacacagaccgatcccgccgcagccgcagccgccgccgcagccgcgacctcctcggcggaggtgcagacggacccctggctgccgccggcgatgtcagctccccgcgcgcgccgcggacgcagaaagtacggcgccgccaacgcgctcctgcccgagtacgccttgcatccttccatcgcgcccacccccggctaccgaggctatacctaccgcccgcgaagagccaagggttccacccgccgtccccgccgacgcgccgccgccaccacccgccgccgccgccgcagacgccagcccgcactggctccagtctccgtgaggagagtggcgcgcgacggacacaccctggtgctgcccagggcgcgctaccaccccagcatcgtttaaaagcctgttgtggttcttgcagatatggccctcacttgccgcctccgtttcccggtgccgggataccgaggaggaagatcgcgccgcaggaggggtctggccggccgcggcctgagcggaggcagccgccgcgcgcaccggcggcgacgcgccaccagccgacgcatgcgcggcggggtgctgcccctgttaatccccctgatcgccgcggcgatcggcgccgtgcccgggatcgcctccgtggccttgcaagcgtcccagaggcattgacagacttgcaaacttgcaaatatggaaaaaaaaaaaaaaccccaataaaaagtctagactctcacgctcgcttggtcctgtgactattttgtagaatggaagacatcaactttgcgtcgctggccccgcgtcacggctcgcgcccgttcctgggacactggaacgatatcggcaccagcaacatgagcggtggcgccttcagttggggctctctgtggagcggcattaaaagtatcgggtctgccgttaaaaattacggctcccgggcctggaacagcagcacgggccagatgttgagagacaagttgaaagagcagaacttccagcagaaggtggtggagggcctggcctccggcatcaacggggtggtggacctggccaaccaggccgtgcagaataaaatcaacagcagactggacccccggccgccggtggaggaggtgccgccggcgctggagacggtgtcccccgatgggcgtggcgagaagcgcccgcggcccgatagggaagagaccactctggtcacgcagaccgatgagccgcccccgtatgaggaggccctaaagcaaggtctgcccaccacgcggcccatcgcgcccatggccaccggggtggtgggccgccacacccccgccacgctggacttgcctccgcccgccgatgtgccgcagcagcagaaggcggcacagccgggcccgcccgcgaccgcctcccgttcctccgccggtcctctgcgccgcgcggccagcggcccccgcgggggggtcgcgaggcacggcaactggcagagcacgctgaacagcatcgtgggtctgggggtgcggtccgtgaagcgccgccgatgctactgaatagcttagctaacgtgttgtatgtgtgtatgcgccctatgtcgccgccagaggagctgctgagtcgccgccgttcgcgcgcccaccaccaccgccactccgcccctcaagatggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctttccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctctattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggaaggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctacccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaaagaagcaagccgcagtcatcgccgcctgcatgccgtcgggttccaccgagcaagagctcagggccatcgtcagagacctgggatgcgggccctattttttgggcaccttcgacaagcgcttccctggctttgtctccccacacaagctggcctgcgccatcgtcaacacggccggccgcgagaccgggggcgtgcactggctggcctttgcctggaacccgcgctccaaaacatgcttcctctttgaccccttcggcttttcggaccagcggctcaagcaaatctacgagttcgagtacgagggcttgctgcgtcgcagcgccatcgcctcctcgcccgaccgctgcgtcaccctcgaaaagtccacccagaccgtgcaggggcccgactcggccgcctgcggtctcttctgctgcatgtttctgcacgcctttgtgcactggcctcagagtcccatggaccgcaaccccaccatgaacttgctgacgggggtgcccaactccatgctccaaagcccccaggtcgagcccaccctgcgccgcaaccaggagcagctctacagcttcctggagcgccactcgccctacttccgccgccacagcgcacagatcaggagggccacctccttctgccacttgcaagagatgcaagaagggtaataacgatgtacacacttttttctcaataaatggcattttttttttatttatacaagctctctggggtattcatttcccaccaccaccacccgccgttgtcgccatctggctctatttagaaatcgaaagggttctgccgggagtcgccgtgcgccacgggcagggacacgttgcgatactggtagcgggtgccccacttgaactcgggcaccaccaggcgaggcagctcggggaagttttcgctccacaggctgcgggtcagcaccagcgcgttcatcaggtcgggcgccgagatcttgaagtcgcagttggggccgccgccctgcgcgcgcgagttgcggtacaccgggttgcagcactggaacaccaacagcgccgggtgcttcacgctggccagcacgctgcggtcggagatcagctcggcgtccaggtcctccgcgttgctcagcgcgaacggggtcatcttgggcacttgccgccccaggaagggcgcgtgccccggtttcgagttgcagtcgcagcgcagcgggatcagcaggtgcccgtgcccggactcggcgttggggtacagcgcgcgcatgaaggcctgcatctggcggaaggccatctgggccttggcgccctccgagaagaacatgccgcaggacttgcccgagaactggtttgcggggcagctggcgtcgtgcaggcagcagcgcgcgtcggtgttggcgatctgcaccacgttgcgcccccaccggttcttcacgatcttggccttggacgattgctccttcagcgcgcgctgcccgttctcgctggtcacatccatctcgatcacatgttccttgttcaccatgctgctgccgtgcagacacttcagctcgccctccgtctcggtgcagcggtgctgccacagcgcgcagcccgtgggctcgaaagacttgtaggtcacctccgcgaaggactgcaggtacccctgcaaaaagcggcccatcatggtcacgaaggtcttgttgctgctgaaggtcagctgcagcccgcggtgctcctcgttcagccaggtcttgcacacggccgccagcgcctccacctggtcgggcagcatcttgaagttcaccttcagctcattctccacgtggtacttgtccatcagcgtgcgcgccgcctccatgcccttctcccaggccgacaccagcggcaggctcacggggttcttcaccatcaccgtggccgccgcctccgccgcgctttcgctttccgccccgctgttctcttcctcttcctcctcttcctcgccgccgcccactcgcagcccccgcaccacggggtcgtcttcctgcaggcgctgcaccttgcgcttgccgttgcgcccctgcttgatgcgcacgggcgggttgctgaagcccaccatcaccagcgcggcctcttcttgctcgtcctcgctgtccagaatgacctccggggagggggggttggtcatcctcagtaccgaggcacgcttctttttcttcctgggggcgttcgccagctccgcggctgcggccgctgccgaggtcgaaggccgagggctgggcgtgcgcggcaccagcgcgtcttgcgagccgtcctcgtcctcctcggactcgagacggaggcgggcccgcttcttcgggggcgcgcggggcggcggaggcggcggcggcgacggagacggggacgagacatcgtccagggtgggtggacggcgggccgcgccgcgtccgcgctcgggggtggtttcgcgctggtcctcttcccgactggccatctcccactgctccttctcctataggcagaaagagatcatggagtctctcatgcgagtcgagaaggaggaggacagcctaaccgccccctctgagccctccaccaccgccgccaccaccgccaatgccgccgcggacgacgcgcccaccgagaccaccgccagtaccaccctccccagcgacgcacccccgctcgagaatgaagtgctgatcgagcaggacccgggttttgtgagcggagaggaggatgaggtggatgagaaggagaaggaggaggtcgccgcctcagtgccaaaagaggataaaaagcaagaccaggacgacgcagataaggatgagacagcagtcgggcgggggaacggaagccatgatgctgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccgcacgtgccccccaagcgccgggagaacggcacctgcgagcccaacccgcgtctcaacttctacccggtcttcgcggtacccgaggtgctggccacctaccacatcttcttccaaaactgcaagatccccctctcctgccgcgctaaccgcacccgcgccgacaaaaccctgaccctgcggcagggcgcccacatacctgatattgcctctctggaggaagtgcccaagatcttcgagggtctcggtcgcgacgagaaacgggcggcgaacgctctgcacggagacagcgaaaacgagagtcactcgggggtgctggtggagctcgagggcgacaacgcgcgcctggccgtactcaagcgcagcatagaggtcacccactttgcctacccggcgctcaacctgccccccaaggtcatgagtgtggtcatgggcgagctcatcatgcgccgcgctcagcccctggccgcggatgcaaacttgcaagagtcctccgaggaaggcctgcccgcggtcagcgacgagcagctagcgcgctggctggagacccgcgaccccgcgcagctggaggagcggcgcaagctcatgatggccgcggtgctggtcaccgtggagctcgagtgtctgcagcgcttcttcgcggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacatccgcgactgcgcctacctcttcctctgctacacctggcagacggccatgggggtctggcagcagtgcctggaggagcgcaacctcaaggagctggaaaagctactcaagcgcaccctcagggacctctggacgggcttcaacgagcgctcggtggccgccgcgctggcggacatcatcttccccgagcgcctgctcaagaccctgcagcagggcctgcccgacttcaccagccagagcatgctgcagaactttaggactttcatcctggagcgctcgggcatcctgcctgccacttgctgcgcgctgcccagcgacttcgtgcccatcaagtacagggagtgcccgccgccgctctggggccactgctacctcttccagctggccaactacctcgcctaccactcggacctcatggaagacgtgagcggcgagggcctgctcgagtgccactgccgctgcaacctctgcacgccccaccgctctctagtctgcaacccgcagctgctcagcgagagtcagattatcggtaccttcgagctgcagggtccctcgcctgacgagaagtccgcggctccggggctgaaactcactccggggctgtggacttccgcctacctacgcaaatttgtacctgaggactaccacgcccacgagatcaggttctacgaagaccaatcccgcccgcccaaggcggagctcaccgcctgcgtcatcacccaggggcacatcctgggccaattgcaagccatcaacaaagcccgccgagagttcttgctgaaaaagggtcggggggtgtacctggacccccagtccggcgaggagctaaacccgctacccccgccgccgccccagcagcgggaccttgcttcccaggatggcacccagaaagaagcagcagccgccgccgccgcagccatacatgcttctggaggaagaggaggaggactgggacagtcaggcagaggaggtttcggacgaggagcaggaggagatgatggaagactgggaggaggacagcagcctagacgaggaagcttcagaggccgaagaggtggcagacgcaacaccatcaccctcggtcgcagccccctcgccggggcccctgaaatcctccgaacccagcaccagcgctataacctccgctcctccggcgccggcgccacccgcccgcagacccaaccgtagatgggacaccacaggaaccggggtcggtaagtccaagtgcccgccgccgccaccgcagcagcagcagcagcgccagggctaccgctcgtggcgcgggcacaagaacgccatagtcgcctgcttgcaagactgcgggggcaacatctctttcgcccggcgcttcctgctattccaccacggggtcgcctttccccgcaatgtcctgcattactaccgtcatctctacagcccctactgcagcggcgacccagaggcggcagcggcagccacagcggcgaccaccacctaggaagatatcctccgcgggcaagacagcggcagcagcggccaggagacccgcggcagcagcggcgggagcggtgggcgcactgcgcctctcgcccaacgaacccctctcgacccgggagctcagacacaggatcttccccactttgtatgccatcttccaacagagcagaggccaggagcaggagctgaaaataaaaaacagatctctgcgctccctcacccgcagctgtctgtatcacaaaagcgaagatcagcttcggcgcacgctggaggacgcggaggcactcttcagcaaatactgcgcgctcactcttaaagactagctccgcgcccttctcgaatttaggcgggagaaaactacgtcatcgccggccgccgcccagcccgcccagccgagatgagcaaagagattcccacgccatacatgtggagctaccagccgcagatgggactcgcggcgggagcggcccaggactactccacccgcatgaactacatgagcgcgggaccccacatgatctcacaggtcaacgggatccgcgcccagcgaaaccaaatactgctggaacaggcggccatcaccgccacgccccgccataatctcaacccccgaaattggcccgccgccctcgtgtaccaggaaaccccctccgccaccaccgtactacttccgcgtgacgcccaggccgaagtccagatgactaactcaggggcgcagctcgcgggcggctttcgtcacggggcgcggccgctccgaccaggtataagacacctgatgatcagaggccgaggtatccagctcaacgacgagtcggtgagctcttcgctcggtctccgtccggacggaactttccagctcgccggatccggccgctcttcgttcacgccccgccaggcgtacctgactctgcagacctcgtcctcggagccccgctccggaggcatcggaaccctccagttcgtggaggagttcgtgccctcggtctacttcaaccccttctcgggacctcccggacgctaccccgaccagttcattccgaactttgacgcggtgaaggactcggcggacggctacgactgaatgtcaggtgccgaggcagagcagcttcgcctgagacacctcgagcactgccgccgccacaagtgcttcgcccgcggttccggtgagttctgctactttcagctacccgaggagcataccgaggggccggcgcacggcgtccgcctgaccacccagggcgaggttacctgttccctcatccgggagttcaccctccgtcccctgctagtggagcgggagcggggtccctgtgtcctaactatcgcctgcaactgccctaaccctggattacatcaagatctttgctgtcatctctgtgctgagtttaataaacgctgagatcagaatctactggggctcctgtcgccatcctgtgaacgccaccgtcttcacccaccccgaccaggcccaggcgaacctcacctgcggtctgcatcggagggccaagaagtacctcacctggtacttcaacggcaccccctttgtggtttacaacagcttcgacggggacggagtctccctgaaagaccagctctccggtctcagctactccatccacaagaacaccaccctccaactcttccctccctacctgccgggaacctacgagtgcgtcaccggccgctgcacccacctcacccgcctgatcgtaaaccagagctttccgggaacagataactccctcttccccagaacaggaggtgagctcaggaaactccccggggaccagggcggagacgtaccttcgacccttgtggggttaggattttttattaccgggttgctggctcttttaatcaaagcttccttgagatttgttctttccttctacgtgtatgaacacctcagcctccaataactctaccctttcttcggaatcaggtgacttctctgaaatcgggcttggtgtgctgcttactctgttgatttttttccttatcatactcagccttctgtgcctcaggctcgccgcctgctgcgcacacatctatatctactgctggttgctcaagtgcaggggtcgccacccaagatgaacaggtacatggtcctatcgatcctaggcctgctggccctggcggcctgcagcgccgccaaaaaagagattacctttgaggagcccgcttgcaatgtaactttcaagcccgagggtgaccaatgcaccaccctcgtcaaatgcgttaccaatcatgagaggctgcgcatcgactacaaaaacaaaactggccagtttgcggtctatagtgtgtttacgcccggagacccctctaactactctgtcaccgtcttccagggcggacagtctaagatattcaattacactttccctttttatgagttatgcgatgcggtcatgtacatgtcaaaacagtacaacctgtggcctccctctccccaggcgtgtgtggaaaatactgggtcttactgctgtatggctttggcaatcactacgctcgctctaatctgcacggtgctatacataaaattcaggcagaggcgaatctttatcgatgaaaagaaaatgccttgatcgctaacaccggctttctatctgcagaatgaatgcaatcacctccctactaatcaccaccaccctccttgcgattgcccatgggttgacacgaatcgaagtgccagtggggtccaatgtcaccatggtgggccccgccggcaattccaccctcatgtgggaaaaatttgtccgcaatcaatgggttcatttctgctctaaccgaatcagtatcaagcccagagccatctgcgatgggcaaaatctaactctgatcaatgtgcaaatgatggatgctgggtactattacgggcagcggggagaaatcattaattactggcgaccccacaaggactacatgctgcatgtagtcgaggcacttcccactaccacccccactaccacctctcccaccaccactaccaccactactactactactactaccactaccgctgcccgccatacccgcaaaagcaccatgattagcacaaagccccctcgtgctcactcccacgccggcgggcccatcggtgcgacctcagaaaccaccgagctttgcttctgccaatgcactaacgccagcgctcatgaactgttcgacctggagaatgaggatgcccagcagagctccgcttgcctgacccaggaggctgtggagcccgttgccctgaagcagatcggtgattcaataattgactcttcttcttttgccactcccgaataccctcccgattctactttccacatcacgggtaccaaagaccctaacctctctttctacctgatgctgctgctctgtatctctgtggtctcttccgcgctgatgttactggggatgttctgctgcctgatctgccgcagaaagagaaaagctcgctctcagggccaaccactgatgcccttcccctaccccccggattttgcagataacaagatatgagctcgctgctgacactaaccgctttactagcctgcgctctaacccttgtcgcttgcgactcgagattccacaatgtcacagctgtggcaggagaaaatgttactttcaactccacggccgatacccagtggtcgtggagtggctcaggtagctacttaactatctgcaatagctccacttcccccagcatatccccaaccaagtaccaatgcaatgccagcctgttcaccctcatcaacgcttccaccctggacaatggactctatgtaggctatgtaccctttggtgggcaaggaaagacccacgcttacaacctggaagttcgccagcccagaaccactacccaagcttctcccaccaccaccaccaccaccaccaccaccatcaccagcagcagcagcagccacagcagcagcagcagattattgactttggttttggccagctcatctgccgctacccaggccatctacagctctgtgcccgaaaccactcagatccaccgcccagaaacgaccaccgccaccaccctacacacctccagcgatcagatgccgaccaacatcacccccttggctcttcaaatgggacttacaagccccactccaaaaccagtggatgcggccgaggtctccgccctcgtcaatgactgggcggggctgggaatgtggtggttcgccataggcatgatggcgctctgcctgcttctgctctggctcatctgctgcctccaccgcaggcgagccagaccccccatctatagacccatcattgtcctgaaccccgataatgatgggatccatagattggatggcctgaaaaacctacttttttcttttacagtatgataaattgagacatgcctcgcattttcttgtacatgttccttctcccaccttttctggggtgttctacgctggccgctgtgtctcacctggaggtagactgcctctcacccttcactgtctacctgctttacggattggtcaccctcactctcatctgcagcctaatcacagtaatcatcgccttcatccagtgcattgattacatctgtgtgcgcctcgcatacttcagacaccacccgcagtaccgagacaggaacattgcccaacttctaagactgctctaatcatgcataagactgtgatctgccttctgatcctctgcatcctgcccaccctcacctcctgccagtacaccacaaaatctccgcgcaaaagacatgcctcctgccgcttcacccaactgtggaatatacccaaatgctacaacgaaaagagcgagctctccgaagcttggctgtatggggtcatctgtgtcttagttttctgcagcactgtctttgccctcatgatctacccctactttgatttgggatggaacgcgatcgatgccatgaattaccccacctttcccgcacccgagataattccactgcgacaagttgtacccgttgtcgttaatcaacgccccccatcccctacgcccactgaaatcagctactttaacctaacaggcggagatgactgacgccctagatctagaaatggacggcatcagtaccgagcagcgtctcctagagaggcgcaggcaggcggctgagcaagagcgcctcaatcaggagctccgagatctcgttaacctgcaccagtgcaaaagaggcatcttttgtctggtaaagcaggccaaagtcacctacgagaagaccggcaacagccaccgcctcagttacaaattgcccacccagcgccagaagctggtgctcatggtgggtgagaatcccatcaccgtcacccagcactcggtagagaccgaggggtgtctgcactctccctgtcggggtccagaagacctctgcaccctggtaaagaccctgtgcggtctcagagatttagtcccctttaactaatcaaacactggaatcaataaaaagaatcacttacttaaaatcagacagcaggtctctgtccagtttattcagcagcacctccttcccctcctcccaactctggtactccaaacgccttctggcggcaaacttcctccacaccctgaagggaatgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagcccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtaagcacctcaggcgccctcaccgtagcagccgccgctcccctggcagtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcaccgttagcgccacaccaccaattaatgtaagcagtggaagtttaggcttagacatggaagaccctatgtatactcacgatggaaaactgggaataagaattgggggtccactaagagtagtagacagcttgcacacactcactgtagttaccggaaatggactaactgtagataacaatgccctccaaactagagttacgggcgccctaggttatgacacatcaggaaatctacaattgagagctgcaggaggtatgcgaattgatgcaaatggccaacttatccttaatgtggcatacccatttgatgctcagaacaatctcagccttagacttggtcagggacccctgtatataaacacagaccacaacctggatttgaattgcaacagaggtctaaccacaactaccaccaacaacacaaaaaaacttgagactaaaattagctcaggcttagactatgacaccaatggtgctgtcattattaaacttggcactggtctaagcttcgacaacacaggcgccctaactgtgggaaacactggtgatgataaactgactctgtggacgaccccagacccatctccaaattgcagaattcactcagacaaagactgcaagtttactctagtcctaactaagtgtggaagccaaatcctggcctctgtcgccgccctagcggtatcaggaaatctggcttcgataacaggcaccgttgccagcgttaccatctttctcagatttgatcagaatggagtgcttatggaaaactcctcgctagacaggcagtactggaacttcagaaatggcaactcaactaacgctgccccctacaccaatgcagttgggttcatgccaaacctcgcagcataccccaaaacgcaaagccagactgctaaaaacaacattgtaagtcaggtttacttgaatggagacaaatccaaacccatgacccttaccatcaccctcaatggaactaatgaatccagtgaaactagccaggtgagtcactactccatgtcatttacatgggcttgggaaagtgggcaatatgccactgaaacctttgccaccaactccttcaccttttcttacattgctgaacaataaaaagcatgacactgatgttcatttctgattcttattttattattttcaaacacaacaaaatcattcaagtcattcttccatcttagcttaatagacacagtagcttaatagacccagtagtgcaaagccccattctagcttatagatcagacagtgataattaaccaccaccaccaccataccttttgattcaggaaatcatgatcatcacaggatcctagtcttcaggccgccccctccctcccaagacacagaatacacagtcctctccccccgactggctttaaataacaccatctggttggtcacagacatgttcttaggggttatattccacacggtctcctgccgcgccaggcgctcgtcggtgatgttgataaactctcccggcagctcgctcaagttcacgtcgctgtccagcggctgaacctccggctgacgcgataactgtgcgaccggctgctggacaaacggaggccgcgcctacaagggggtagagtcataatcctcggtcaggatagggcggtgatgcagcagcagcgagcgaaacatctgctgccgccgccgctccgtccggcaggaaaacaacaagccggtggtctcctccgcgataatccgcaccgcccgcagcatcagcttcctcgttctccgcgcgcagcacctcaccctgatctcgctcaagtcggcgcagtaggtacagcacagcaccacgatgttattcatgatcccacagtgcagggcgctgtatccaaagctcatgccgggaaccaccgcccccacgtggccatcgtaccacaagcgcacgtaaattaagtgtcgacccctcatgaacgtgctggacacaaacattacttccttgggcatgttgtaattcaccacctcccggtaccagataaacctctggttaaacagggcaccttccaccaccatcctgaaccaagaggccagaacctgcccaccggctatgcactgcagggaacccgggttggaacaatgacaatgcagactccaaggctcgtaaccgtggatcatccggctgctgaaggcatcgatgttggcacaacacagacacacgtgcatgcactttctcatgattagcagctcttccctcgtcaggatcatatcccaaggaataacccattcttgaatcaacgtaaaacccacacagcagggaaggcctcgcacataactcacgttgtgcatggtcagcgtgttgcattctggaaacagcggatgatcctccagtatcgaggcgcgggtctccttctcacagggaggtaaagggtccctgctgtacggactgcgccgggacgaccgagatcgtgttgagcgtagtgtcatggaaaagggaacgccggacgtggtcatacttcttgaagcagaaccaggttcgcgcgtggcaggcctccttgcgtctgcggtctcgccgtctagctcgctccgtgtgatagttgtagtacagccactcccgcagagcgtcgaggcgcaccctggcttccggatctatgtagactccgtcttgcaccgcggccctgataatatccaccaccgtagaataagcaacacccagccaagcaatacactcgctctgcgagcggcagacaggaggagcgggcagagatgggagaaccatgataaaaaactttttttaaagaatattttccaattcttcgaaagtaagatctatcaagtggcagcgctcccctccactggcgcggtcaaactctacggccaaagcacagacaacggcatttctaagatgttccttaatggcgtccaaaagacacaccgctctcaagttgcagtaaactatgaatgaaaacccatccggctgattttccaatatagacgcgccggcggcgtccaccaaacccagataattttcttctctccagcggtttagaatctgtctaagcaaatcccttatatcaagtccggccatgccaaaaatctgctcaagagcgccctccaccttcatgaccaagcagcgcatcatgattgcaaaaattcaggttcttcagagacctgtataagattcaaaatgggaacattaacaaaaattcctctgtcgcgcagatcccttcgcagggcaagctgaacataatcagacaggtctgaacggaccagtgaggccaaatccccaccaggaaccagatccagagaccctatactgattatgacgcgcatactcggggctatgctgaccagcgtagcgccgatgtaggcgtgctgcatgggcggcgagataaaatgcaaagtgctggttaaaaaatcaggcaaagcctcgcgcaaaaaagctaacacatcataatcatgctcatgcaggtagttgcaggtaagctcaggaaccaaaacggaataacacacgattttcctctcaaacatgacttcgcggatactgcgtaaaacaaaaattataaataaaaaattaattaacttaaacattggaagcctgtctcacaacaggaaaaaccactttaatcaacataagacgggccacgggcatgccggcatagccgtaaaaaaattggtccccgtgattaacaagtaccacagacagctccccggtcatgtcgggggtcatcatgtgagactctgtatacacgtctggattgtgaacatcagacaaacaaagaaatcgagccacgtagcccggaggtataatcacccgcaggcggaggtacagcaaaacgacccccataggaggaatcacaaaattagtaggagaaaaaaatacataaacaccagaaaaaccctgttgctgaggcaaaatagcgccctcccgatccaaaacaacataaagcgcttccacaggagcagccataacaaagacccgagtcttaccagtaaaagaaaaaagatctctcaacgcagcaccagcaccaacacttcgcagtgtaaaaggccaagtgccgagagagtatatataggaataaaaagtgacgtaaacgggcaaagtccaaaaaacgcccagaaaaaccgcacgcgaacctacgccccgaaacgaaagccaaaaaacactagacactcccttccggcgtcaacttccgctttcccacgctacgtcacttgccccagtcaaacaaactacatatcccgaacttccaagtcgccacgcccaaaacaccgcctacacctccccgcccgccggcccgcccccaaacccgcctcccgccccgcgccccgcctcgcgccgcccatctcattatcatattggcttcaatccaaaataaggtatattattgatgatg

SEQ ID NO: 2 - DNA, 36648 bp, Chimpanzee Adenvirus-ChAd6 Genomic
catcatcaataatatacctcaaacttttggtgcgcgttaatatgcaaatgagccgtttgaatttggggatgcggggcgctgattggctgcgggagcggcgaccgttaggggcggggcgggtgacgttttgatgacgtgtttgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtaggcgtcagctgatcgccagggtatttaaacctgcgctctctagtcaagaggccactcttgagtgccagcgagtagagttttctcctccgcgccgcgagtcagatctacactttgaaagatgaggcacctgagagacctgcccggtaatgttttcctggctactgggaacgagattctggaactggtggtggacgccatgatgggtgacgaccctcctgagccccctaccccatttgaggcgccttcgctgtacgatttgtatgatctggaggtggatgtgcccgagaacgaccccaacgaggaggcggtgaatgatttgtttagcgatgccgcgctgctggccgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgagcgagggagtgaaagctgcgggcgagagctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagctgggaaggcagagggtgactgggtgctgactggtttatttatgtatatgttttttatgtgtaggtcccgtctctgacgtagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgtgtggtttatgactcaggggtggggactgtgggtatataagcaggtgcagacctgtgtggtcagttcagagcaggactcatggagatctggacggtcttggaagactttcaccagactagacagctgctagagaactcatcggaggaagtctcttacctgtggagattttgcttcggtggggctctagctaagctagtctatagggccaaacaggattataaggatcaatttgaggatattttgagagagtgtcctagtatttttgactctctcaacttgggccatcagtctcactttaaccagagtattctgagagcccttgacttttctactcctggcagaactaccgccgcggtagccttttttgcctttattcttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggaggaggaccgagaagagaacccgagagccggtctggaccctccggtggcggaggaggaggagtagctgacttgtttcccgagctgcgccgggtgctgactaggtcttccagtggacgggagagggggattaagcgggagaggcatgaggagactagtcacagaactgaactgactgtcagtctgatgagccgcaggcgcccagaatcggtgtggtggcatgaggttcagtcgcaggggatagatgaggtctcggtaatgcatgagaaatattccctagaacaagtcaagacttgttggttggagcccgaggatgattgggaggtagccatcaggaattatgccaagctggctctgaggccagacaagaagtacaagattaccaaactgattaatatcagaaattcctgctacatttcggggaatggggccgaggtggagatcagtacccaggagagggtggccttcagatgttgtatgatgaatatgtacccgggggtggtgggcatggagggagtcacctttatgaacgcgaggtttaggggtgatgggtataatggggtggtctttatggccaacaccaagctgacagtgcacggatgctccttctttggcttcaataacatgtgcatcgaggcctggggcagtgtttcagtgaggggatgcagcttttcagccaactggatgggggtcgtgggcagaaccaagagcgtggtgtcagtgaagaaatgcctgttcgagaggtgccacctgggggtgatgagcgagggcgaagccaaagtcaaacactgcgcctctaccgagacgggctgctttgtgatgatcaagggcaatgccaaagtcaagcataacatgatttgtggggcctcggatgagcgcggctaccagatgctgacctgtgccggtgggaacagccatatgctggccaccgtgcatgtggcctcgcacccccgcaagacatggcccgagttcgagcacaacgtcatgacccgctgcaatgtgcacctggggtcccgccgaggcatgttcatgccctaccagtgcaacatgcaatttgtgaaggtgctgctggagcccgatgccatgtccagagtgagcctggtgggggtgtttgacatgaatgtggaggtgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggtgggtgggagtctgcatgatgggcagaatgactaaaatctgtgtttttctgcgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccttgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagagtgcccgactgggggacgaaggtgccctcgatcccgggggcgtagttcccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtgggaccgtagatgaccccgatgaccggctgcaggtggtagttgagggagagacagctgccatcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggtcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtctggggggtcggcgtccacggtgaagatgccgggcaggagctcggggtcgaagtagctgatggaagtggccagatcgtccagggaagcttgccagtcgcgcacggccagcgcgcgctcgtaggggctgaggggcgtgccccagggcatggggtgcgtgagcgcggaggcgtacatgccgcagatgtcgtagacgtagaggggctcctcgaggatgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgttcgagggcccagtcggcgacgtgggggttggcgctgaggaaggaagtccagagatccacggccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggtgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgagttcctttgacgaggaatttcagtgggcagtggagcgctggcggctgcatctggtgctgtactacgtcctggccatcggcgtggccatcgtctgcctcgatggtggtcatgctgacgaggccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctggttccatgccggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcttcttccatctcctcctcctcttcctcctccactaacatctcttctacttcctcctcaggaggcggtggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggcgaggatggcctgctggatctgggtgagggtggtctggaagtcgtcgaagtcgacgaagcggtggtaggctccggtgttgatggtgtatgagcagttggccatgacggaccagttgacggtctggtggccggggcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcacaaaacctccaggatacggaggcgggtcgttttgcaactttttgaggccggaaatgaaactagtaagcgcgaaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttgtttgtttttgccagatgcatcccgtactgcggcagatgcgcccccaccaccctccaccgcaacaacagcccactccacagccggcgcttctgcccccgccccagcagcagcaacttccagccacgaccgccgcggccgccgtgagcggggctggacagacttctcagtatgaccacctggccttggaagagggcgaggggctggcgcgcctgggggcgtcgtcgccggagcggcacccgcgcgtgcagatgaaacgggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcacagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtatgacatgcccgaccccaacgacgggttcctgtgggatgacgtggacagcagcgtgttctcgccgcgccccgccaccaccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggacggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccgcgagctagcagcagcaccggcgcccgtagacgccagcggcacgacaggcagcggggactggtgtgggacgatgaggattccgccgacgacagcagcgtgttggacttgggtgggagtggtggtggtaacccgttcgctcacctgcgcccccgtatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcgcgcaagacccccaacggggtcgcggtaggggatgattatgatggtagtcaggacgagctgacctacgagtgggtggagtttgagctgcccgagggcaacttctcggtgaccatgaccatcgatctgatgaacaacgccatcatcgacaattacttggcggtgggacggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctatgaagaaagtaaggaaaaagcagaggctgaggcaactgcagccgtggctactgccgctgtcaccgatgcagatgcagctactaccaggggcgatacattcgccactgtggctgaagaagcagccgccgtagcggcgaccgatgatagtgaaagtaagatagtcatcaagccggtggagaaggacagcaagaacaggagctacaacgttctatcggatggaaagaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctctggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaattcaaggaagagatgctccaggtcatcgcgcctgagatctacggccccgcggcggcggtgaaggaggaaagaaagccccgcaaactgaagcgggtcaaaaaggacaaaaaggaggaggaagatgtggacggactggtggagtttgtgcgcgagttcgccccccggcggcgcgtgcagtggcgcgggcggaaagtgaaaccggtgctgcgacccggcaccaccgtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagtctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcttccaccaccaccactcgccgaagacgcaagtacggcgcggccagcctgctgatgcccaactacgcgctgcatccttccatcatccccacgccgggctaccgcggcacgcgcttctaccgcggctacagcagccgccgcaagaccaccacccgccgccgccgtcgtcgcacccgccgcagcagcaccgcgacttccgccgccttggtgcggagagtgtaccgcagcgggcgcgagcctctgaccctgccgcgcgcgcgctaccacccgagcatcgccatttaactctgccgtcgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgatgcagaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccccagcttcaaaccctactccggcaccgcctacaacagcctggctcccaagggagcgcccaacacctcacagtggataaccaaagacaatggaactgataagacatacagttttggaaatgctccagtcagaggattggacattacagaagagggtctccaaataggacccgatgagtcagggggtgaaagcaagaaaatttttgcagacaaaacctatcagcctgaacctcagcttggagatgaggaatggcatgatactattggagctgaagacaagtatggaggcagagcgcttaaacctgccaccaacatgaaaccctgctatgggtctttcgccaagccaactaatgctaagggaggtcaggctaaaagcagaaccaaggacgatggcactactgagcctgatattgacatggccttctttgacgatcgcagtcagcaagctagtttcagtccagaacttgttttgtatactgagaatgtcgatctggacaccccggatacccacattatttacaaacctggcactgatgaaacaagttcttctttcaacttgggtcagcagtccatgcccaacagacccaactacatcggcttcagagacaactttatcggtctcatgtactacaacagtactggcaatatgggtgtactagctggacaggcctcccagctgaatgctgtggtggacttgcaggacagaaacactgaactgtcctaccagctcttgcttgactctctgggtgacagaaccaggtatttcagtatgtggaaccaggcggtggacagctacgaccccgatgtgcgcattattgaaaatcacggtgtggaggatgaactacccaactattgcttccctttgaatggtgtgggctttacagatacattccagggaattaaggttaaaactaccaataacggaacagcaaatgctacagagtgggaatctgatacctctgtcaataatgctaatgagattgccaagggcaatcctttcgccatggagatcaacatccaggccaacctgtggcggaacttcctctacgcgaacgtggcgctgtacctgcccgactcctacaagtacacgccggccaacatcacgctgcccgccaacaccaacacctacgattacatgaacggccgcgtggtagcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggttcagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggacagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggtaacgccaccacctaagccccgctcttgcttcttgcaagatgacggcctgtgcgggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcgaacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaagcgctctaccgcttcctcaacgcccactccgcctactttcgctcccaccgcgcgcgcatcgagaaggccaccgccttcgaccgcatgaatcaagacatgtaaaccgtgtgtgtatgtgaatgctttattcataataaacagcacatgtttatgccaccttctctgaggctctgactttatttagaaatcgaaggggttctgccggctctcggcatgccccgcgggcagggatacgttgcggaactggtacttgggcagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcgtgtgctccttctggatcatcacggtcccgtgcaggcaccgcagcttgctctcggcctcggtgcacccgtgcagccacagcgcgcagccggtgctctcccagttcttgtgggcgatctgggagtgcgagtgcacgaagccctgcaggaagcggcccatcatcgcggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatgacttccatgcccttctcccaggccgaaacgatcggcaggctcagggggttcttcaccgttgtcatcttagtcgccgccgccgaggtcagggggtcgttctcgtccagggtctcaaacactcgcttgccgtccttctcgatgatgcgcacgggggggaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttcttcttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaacaacaagcatggagactcagccatcgtcgccaacatcgccatctgcccccgccgccgacgagaaccagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagaaccaggctgggctcgagcatggcgactacctgagcggggcagaggacgtgctcatcaagcatctgacccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggaacatgagcaccacagcgccctggtggagttggaaggcgacaacgcgcgcctggcggtgctcaagcgcacggtcgagctgacccacttcgcctacccggcgctcaacctgccccccaaggtcatgagcgccgtcatggaccaggtgctcatcaagcgcgcctcgcccattgaggacatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcagagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgcaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctggagtgccactgccgctgcaacctctgcacgccgcaccgctccctggcctgcaacccccagctgctgagcgagacccagatcatcggcaccttcgagttgcaaggccccggcgaggagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggagatggaagactgggacagcactcaggcagaggaggacagcctgcaagacagtctggaggaggaagacgaggtggaggaggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagaaaaccagcgacagcggcagcagctagaaaatccacagcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggtctggccgccggcgccgcccaggactactccacccgcatgaactggctcagtgccgggcccgcgatgatctcacgggtgaatgacatccgcgcccatcgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcatcgaagggggcctcgactcccacctgcttcggatcttcagccagcgaccgatcctggtcgagcgcgagcaaggacagacccgtctgaccctgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgccgctccccgctactaacaaccaaactacccaccaacgccaccgtcgcgacctttcctctgaatctaatactaccacccacaccggaggtgagctccgaggtcgaccaacctctgggatttactacggcccctgggaggtggtggggttaatagcgctaggcctagttgtgggtgggcttttggctctctgctacctatacctcccttgctgttcgtacttagtggtgctgtgttgctggtttaagaaatggggaagatcaccctagtgagctgcggtgtgctggtggcggtgttgctttcgattgtgggactgggcggcgcggctgtagtgaaggaggagaaggccgatccctgcttgcatttcaatcccgacaaatgccagctgagttttcagcccgatggcaatcggtgcacggtgctgatcaagtgcggatgggaatgtgagaacgtgagaatcgagtacaataacaagactcggaacaatactctcgcgtccgtgtggcaacccggggaccccgagtggtacaccgtctctgtccccggtgctgacggctccccgcgcaccgtgaataatactttcatttttgcgcacatgtgcgacacggtcatgtggatgagcaagcagtacgatatgtggccccccacgaaggagaacatcgtggtcttctccatcgcttacagcgtgtgcacggcgctaatcaccgctatcgtgtgcctgagcattcacatgctcatcgctattcgccccagaaataatgccgaaaaagagaaacagccataacacgttttttcacacacctttttcagaccatggcctctgttactgccctaattatttttttgggtctcgtgggcactagcagcacttttcagcatataaacaaaactgtttatgctggttctaattctgtattacctgggcatcaatcacaccagaaagtttcatggtactggtatgataaaaataacacgccagtcacactctgcaagggtcatcaaacacccataaaccgtagtggaattttttttaaatgtaatcataataatattacactactttcaattacaaagcactattctggtacttactatggaaccaattttaacataaaacaggacacttactatagtgtcacagtattggatccaactactcctagaacaactacaaaacccacaactactaagaggcacactaaacctaaaactaccaagaaaaccactgtcaaaacaacaactaggaccaccacaactacagaggctaccaccagcacaacacttgctgcaactacacacacacacactgagctaaccttacagaccactaatgatttgatagccctgttgcaaaagggggataacagcaccacttccgatgaggaaatacccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttagttttttctatcattacctctgctctttgtgaatcagtgaataaagatgttactattaccactggttctaattatacactgaaagggccaccctcaggtatgctttcgtggtattgctattttggaactgacactgatcaaactgaattatgcaattttcaaaaaggcaaaacctcaaactctaaaatctctaattatcaatgcaatggcactgatctgatactactcaatgtcacgaaagcatatggtggcagttattcttgccctggacaaaacactgaagaaatgattttttacaaagtggaagtggttgatcccactactccacccaccaccacaactactcacaccacacacacagaacaaaccacagcagaggaggcagcaaagttagccttgcaggtccaagacagttcatttgttggcattacccctacacctgatcagcggtgtccggggctgctagtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcactctagttttttgttctttgattggcattgtttttagtgctgggtttttgaaaaatcttaccatttatgaaggtgagaatgccactctagtgggcatcagtggtcaaaatgtcagctggctaaaataccatctagatgggtggaaagacatttgcgattggaatgtcactgtgtatacatgtaatggagttaacctcaccattactaatgccacccaagatcagaatggtaggtttaagggtcagagtttcactagaaataatgggtatgaatcccataacatgtttatctatgacgtcactgtcatcagaaatgagaccgccaccaccacacagatgcccactacacacagttctaccactactaccaagcaaaccacacagacaaccactttttatacatcaactcagcatatgaccaccactacagcagcaaagccaagtagcgcagcgcctcagccacaggctttggctttgaaagctgcacaacctagtacaactactaagaccaatgagcagactactgattttttgtccactgtcgagagccacaccacagctacctccagtgccttctctagcaccgccaatctctcctcgctttcctctacaccaatcagtcccgctactactcctagccccgctcctcttcccactcccctgaagcaaacagacggcggcatgcaatggcagatcaccctgctcattgtgatcgggttggtcatcctggccgtgttgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgttgtagcatagtctgcctgcttatcaccttcttccagttcattgactggatctttgtgcgcatcgcctacctgcgccaccacccccagtaccgcgaccagcgagtggcgcgactgctcaggctcctctgataagcatgcgggctctgctacttctcgcgcttctgctgttagtgctcccccgtcccgtcgacccccggtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcactctatctcccgcctgagcctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaactccgcatccgccagcagcaggagagagccgtcaaggagctgcaggatgcggtggccatccaccagtgcaagaaaggcatcttctgcctggtgaagcaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgagtgcgttcacaccatgatcaagaccctctgcggcctccgcgacctcctccccatgaactaatcacccccttatccagtgaaataaagatcatattgatgatgatttaaataaaaaaataatcatttgatttgaaataaagatacaatcatattgatgatttgagtttaacaaaaataaagaatcacttacttgaaatctgataccaggtctctgtccatgttttctgccaacaccacctcactcccctcttcccagctctggtactgcaggccccggcgggctgcaaacttcctccacacgctgaaggggatgtcaaattcctcctgtccctcaatcttcattttctcttctatcagatgtccaaaaagcgcgcgcgggtggatgatgacttcgaccccgtgtacccctacgatgcagacaacgcaccgactgtgcccttcatcaaccctcccttcgtctcttcagatggattccaagaaaagcccctgggggtgttgtccctgcgactggccgatcccgtcaccaccaagaacggggctgtcaccctcaagctgggggagggggtggacctcgacgactcgggaaaactcatctccaaaaatgccaccaaggccactgcccctctcagtatttccaacaacaccatttcccttaacatggatacccctctttacaacaacaatggaaagctaggtatgaaggtaaccgcaccattaaagatattagacacagatctactaaaaacacttgttgttgcttatgggcagggattaggaacaaacaccaatggtgctcttgttgcccaactagcatacccacttgtttttaataccgctagcaaaattgcccttaatttaggcaatggaccattaaaagtggatgcaaatagactgaacattaattgcaaaagaggtatctatgtcactaccacaaaagatgcactggagattaatatcagttgggcaaatgctatgacatttataggaaatgccattggtgtcaatattgacacaaaaaaaggcctacagttcggcacttcaagcactgaaacagatgttaaaaatgcttttccactccaagtaaaacttggagctggtcttacatttgacagcacaggtgccattgttgcttggaacaaagaagatgacaaacttacactgtggaccacagccgatccatctccaaactgtcacatatattctgcaaaggatgctaagcttacactctgcttgacaaagtgtggtagtcagatactgggcactgtttctctcatagctgttgatactggtagcttaaatccaataacaggaaaagtaaccactgctcttgtttcacttaaattcgatgccaatggagttttgcaagccagttcaacactagataaagaatattggaatttcagaaaaggagatgtgacacctgctgacccctacactaatgctataggctttatgcccaaccttaatgcatacccaaaaaacacaaacgcagctgcaaaaagtcacattgttggaaaagtatacctacatggggatgaaagcaagccactagacttgataattacatttaatgaaaccagtgatgaatcctgtacttattgcattaactttcagtggcagtggggaactgaccaatataaagatgaaacacttgcagtcagttcattcaccttctcatacattgctaaagaataacatccaccctgcatgccaacccatttccctctatctatacatggaaaactctgaagcagaaaaaataaagttcaagtgttttattgattcaacagtttttacagaattcgagtagttattttccctccaccctcccaactcatggaatacaccatcctctccccacgcacagccttaaacatctgaatgccattggtaatggacatggttttggcctccacattccacacagtttcagagcgagccagtctcgggtcggtcagggagatgaaaccctccgggcactcctgcatctgcacctcacagttcaacagctgagggctgtcctcggtggtcgggatcacagttatctggaagaagagcgatgagagtcataatccgcgaacgggatcgggcggttgtggcgcatcaggccccgcagcagtcgctgtctgcgccgctccgtcaagctgctgctcaaggggtccgggtccagggactccccgcgcatgatgccgatggccctgagcatcagtcgcctggtgcggcgggcgcagcagcggatgcggatctcactcaggtcggaacagtacgtgcagcacagcactaccaagttgttcaacagtccatagttcaacgtgctccagccaaaactcatctgtggaactatgctgcccacatgtccatcgtaccagatcctgatgtaaatcaggtggcgccccctccagaacacactgcccatgtacatgatctccttgggcatgtgcaggttcaccacctcccggtaccacatcacccgctggttgaacatgcagccccggatgatcctgcggaaccacagggccagcaccgccccgcccgccatgcagcgcagggaccccgggtcctggcaatggcagtggatgatccaccgctcgtacccgtggatcatctgggagctgaacaagtctatgttggcacagcacaggcacacgctcatgcatctcttcagcactctcagctcctcgggggtcaaaaccatatcccagggtacggggaactcttgcaggacagcgaaccccgcagaacagggcaaacctcgcacagaacttacattgtgcatggacagggtatcgcaatcaggcagcaccgggtgatcctccaccagggaagcgcgggtctcgatttcctcacagcgtggtaagggggccggtcgatacgggtgatggcgggacgcggctgatcgtgttcgcgatcgtgtcatgatgcagttgctttcggacattttcgtacttgctatagcagaacctggtccgggcgctgcacaccgatcgccggcggcggtctcggcgcttggaacgctccgtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaactttaatccaaacggtctcggagcacttcaaaatgaaggtcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaactctctgccgcgatccctaagctcctccctcagcaataactgtaagtactctctcatatcctctccgaaatttttagccataggaccgccaggaataagattagggcaagccacagtacagataaaccgaagtcctccccagtgagcattgccaaatgcaagactgctataagcatgctggctagacccggtgatatcttccagataattggacagaaaatcgcccaggcaatttttaagaaaatcaacaaaagaaaaatcctccaggtgcacgtttagagcctcgggaacaacgatggagtaaatgcaagcggtgcgttccagcatggttagttagctgatctgtagaaaaaacaaaaatgaacattaaaccatgctagcctggcgaacaggtgggtaaatcgttctttccagcaccaggcaggccacggggtctccggcgcgaccctcgtaaaaattgtcgctatgattgaaaaccatcacagagagacgttcccggtggccggcgtgaatgattcgacaagacgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcggcacacaacaggcgcaaaagtcagagaaaggctgagagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcaactttcaaattccgtcgaccgttaaaaacgtcacccgccccgcccctaacggtcgccgctcccgcagccaatcagcgccccgcatccccaaattcaaacggctcatttgcatattaacgcgcaccaaaagtttgaggtatattattgatgatg

SEQ ID NO: 3 - DNA, 36606 bp, Chimpanzee Pan 6 (CV32) Genomic
  misc_feature (3592)...(3592): n = a, t, c, or g
  misc_feature (7705)...(7705): n = a, t, c, or g
  misc_feature (11272)...(11272): n = a, t, c, or g
  misc_feature (11275)...(11275): n = a, t, c, or g
  misc_feature (15203)...(15203): n = a, t, c, or g
  misc_feature (24396)...(24396): n = a, t, c, or g
  misc_feature (27010)...(27010): n = a, t, c or g
  misc_feature (28655)...(28655): n = a, t, c, or g
  misc_feature (30744)...(30744): n = a, t, c, or g
  misc_feature (31045)...(31045): n = a, t, c, or g
catcatcaataatatacctcaaacttttggtgcgcgttaatatgcaaatgagctgtttgaatttggggagggaggaaggtgattggctgcgggagcggcgaccgttaggggcggggcgggtgacgttttgatgacgtggctatgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtaggcgtcagctgatcgccagggtatttaaacctgcgctctctagtcaagaggccactcttgagtgccagcgagtagagttttctcctccgcgccgcgagtcagatctacactttgaaagatgaggcacctgagagacctgcccggtaatgttttcctggctactgggaacgagattctggaattggtggtggacgccatgatgggtgacgaccctccagagccccctaccccatttgaggcgccttcgctgtacgatttgtatgatctggaggtggatgtgcccgagagcgaccctaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcggtgaaccagggagtgaaaactgcgggcgagagctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttgggaaggcagagggtgactgggtgctgactggtttatttatgtatatgtttttttatgtgtaggtcccgtctctgacgtagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtgttttatgactcaggggtggggactgtgggtatataagcaggtgcagacctgtgtggtcagttcagagcaggactcatggagatctggactgtcttggaagactttcaccagactagacagttgctagagaactcatcggagggagtctcttacctgtggagattctgcttcggtgggcctctagctaagctagtctatagggccaaacaggattataaggaacaatttgaggatattttgagagagtgtcctggtatttttgactctctcaacttgggccatcagtctcactttaaccagagtattctgagagcccttgacttttctactcctggcagaactaccgccgcggtagccttttttgcctttattcttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaccgagaagagaacccgagagccggtctggaccctccggtggcggaggaggaggagtagctgacttgtttcccgagctgcgccgggtgctgactaggtcttccagtggacgggagagggggattaagcgggagaggcatgaggagactagccacagaactgaactgactgtcagtctgatgagccgcaggcgcccagaatcggtgtggtggcatgaggtgcagtcgcaggggatagatgaggtctcggtgatgcatgagaaatattccctagaacaagtcaagacttgttggttggagcccgaggatgattgggaggtagccatcaggaattatgccaagctggctctgaagccagacaagaagtacaagattaccaaactgattaatatcagaaattcctgctacatttcagggaatggggccgaggtggagatcagtacccaggagagggtggccttcagatgttgtatgatgaatatgtacccgggggtggtgggcatggagggagtcacctttatgaacacgaggttcaggggtgatgggtataatggggtggtctttatggccaacaccaagctgacagtgcacggatgctccttctttggcttcaataacatgtgcatcgaggcctggggcagtgtttcagtgaggggatgcagcttttcagccaactggatgggggtcgtgggcagaaccaagagcaaggtgtcagtgaagaaatgcctgttcgagaggtgccacctgggggtgatgagcgagggcgaagccaaagtcaaacactgcgcctctaccgagacgggctgctttgtgctgatcaagggcaatgcccaagtcaagcataacatgatctgtggggcctcggatgagcgcggctaccagatgctgacctgcgccggtgggaacagccatatgctggccaccgtgcatgtggcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttggggctgggtgtgagcctgcatgaggggcagaatgactaaaatctgtggttttctgtgtgttgcagcagcatgagcggaagcgcctcctttgagggaggggtattcagcccttatctgacggggcgtctcccctcctgggcgggagtgtgtcagaatgttatggnatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcggggatggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcaaccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatttggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagattgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctttggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttaggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgttggcccacggccattttttcgggggtgacgcagtagaaggtgcgggggtcgccgtgccancggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttggcgaggaatttcagtgggcagtggagcgctggcggctgcatctcgtgctgtactacgtcttggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggctacgtccacggcttgcagggtgccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgttccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcttccatctcctcctcttcctcctccactaacatctcttctacttcctcctcaggaggcggtggcgggggaggggccctgcgtcgccggcggcgcacgggcagacggtcgatgaagcgctcgatggtctccccgcgccggcgacgcatggtctcggtgacggcgcgcccgtcctcgcggggccgcagcatgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggtgaggatggcctgctggatctgggtgagggtggtctggaagtcgtcgaagtcgacgaagcggtggtaggctccggtgttgatggtgtaggagcagttggccatgacggaccagttgacggtctggtggccgggtcgcacgagctcgtggtacttgaggcgcgagtaggcgcgcgtgtcgaagatgtagtcgttgcaggcgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcggccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttttttcttgtgtttttgccagatgcatcccgtactgcggcagatgcgcccccaccctccaccacaaccgcccctaccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctgaaccgaaagcgggtgctgagggacgaggatttcgaggcggacgagctgacggggatcagccccgtgcgcgcgcacgtggtcgnggncaacctggtcacggcgtacgagcagaccgtgaaggaggagagcaacttccaaaaatccttcaacaaccacgtgcgcaccttgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattttgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggtgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcggacaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgcggcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgtccaggaaccaatgccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcgaccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcgcaggcacccgtagacgccagcggcacgacaggcagcggggactggtgtgggacgatgaggattccgccgacgacagcagcgtgttggacttgggtgggagtggtggtaacccgttcgctcacctgcgcccccgtatcgggcgcctgatgtaagaatctgaaaaaataaaagacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcagacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtggatgatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcaccgccgcggcgaccgcagccgtggccaccgcctctaccgaggtgcggggcgataattttgctagcgctgcggcagcggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagnagctgcgcgccttcacctcgctcacgcacgtcttcaaccgcttccccgagaaccagatcctcgtccgccgccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcaccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcgtacggcaagcgcagccgccccgcgcccttgaaagaggaggcggtgtccatcccgctggaccacggcaaccccacgccgagcctgaagccggtgaccctgcagcaggtgctaccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccagcaccagcttccaccagcactcgccgaagacgcaagtacggcgcggccagcctgctgatgcccaactacgcggctgcatccttccatcatccccacgccgggctaccgcggcacgcgcttctaccgcggctacaccagcagccgccgccgcaagaccaccacccgccgccgtcgtcgcagccgccgcagcagcaccgcgacttccgccttggtgcggagagtgtatcgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacaaaaaagcatggatttgtaataaaaaaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagaacagaacttccagcagaaggtggttgatggcctggcctcaggcatcaacggggtggttgacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggcctgcccaccacgcggcccgtggcgcctctggccaccggagtgctgaaacccagcagcagccagcccgcgaccctggacttgcctccgcctcgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggagtgtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacaatgtgaccaccgaccgcagccagcggctgacggtgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactctggcaccgcctacaacagcctagctcccaagggagctcccaattccagccagtgggagcaagcaaaaacaggcaatgggggaactatggaaacacacacatatggtgtggccccaatgggcggagagaatattacaaaagatggtcttcaaattggaactgacgttacagcgaatcagaataaaccaatttatgccgacaaaacatttcaaccagaaccgcaagtaggagaagaaaattggcaagaaactgaaaacttttatggcggtagagctcttaaaaaagacacaaacatgaaaccttgctatggctcctatgctagacccaccaatgaaaaaggaggtcaagctaaacttaaagttggagatgatggagttccaaccaaagaattcgacatagacctggctttctttgatactcccggtggcaccgtgaacggtcaagacgagtataaagcagacattgtcatgtataccgaaaacacgtatttggaaactccagacacgcatgtggtatacaaaccaggcaaggatgatgcaagttctgaaattaacctggttcagcagtctatgcccaacagacccaactacattgggttcagggacaactttatcggtcttatgtactacaacagcactggcaatatgggtgtgcttgctggtcaggcctcccagctgaatgctgtggttgatttgcaagacagaaacaccgagctgtcctaccagctcttgcttgactctttgggtgacagaacccggtatttcagtatgtggaaccaggcggtggacagttatgaccccgatgtgcgcatcatcgaaaaccatggtgtggaggatgaattgccaaactattgcttccccttggacggctctggcactaacgccgcataccaaggtgtgaaagtaaaagatggtcaagatggtgatgttgagagtgaatgggaaaatgacgatactgttgcagctcgaaatcaattatgtaaaggtaacattttcgccatggagattaatctccaggctaacctgtggagaagtttcctctactcgaacgtggccctgtacctgcccgactcctacaagtacacgccgaccaacgtcacgctgccgaccaacaccaacacctacgattacatgaatggcagagtgacacctccctcgctggtagacgcctacctcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctaggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctgaagacccgcgagacgccctcgctcggctccgggttcgacccctacttcgtctactcgggctccatcccctacctagacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcttcctcaatgcccactccgcctactttcgctcccaccgcgcgcgcatcgagaaggccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaagccgtctacctgcgcacgcccttctcggccggcaacgccaccacctaagccgctcttgcttcttgcaagatgacggcgggctccggcgagcaggagctcagggccatcctccgcgacctgggctgcgggccctgcttcctgggcaccttcgacaagcgcttccctggattcatggccccgcacaagctggcctgcgccatcgtgaacacggccggccgcgagaccgggggcgagcactggctggccttcgcctggaacccgcgctcccacacatgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaagcgctctaccccgccttcgaccgcatgaatcaagacatgtaaaaaaccggtgtgtgtatgtgaatgctttattcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagccttcagctggcggaaggcctgctgcgccttgccgccctcggtgaagaagaccccgcaggacttgctagagaactggttggtggcgcagccggcgtcgtgcacgcagcagcgcgcgtcgttgttggccagctgcaccacgctgcgcccccagcggttctgggtgatcttggcccggttggggttctccttcagcgcgcgctgcccgttctcgctcgccacatccatctcgatagtgtgctccttctggatcatcacggtcccgtgcaggcaccgcagcttgccctcggcttcggtgcagccgtgcagccacagcgcgcagccggtgcactcccagttcttgtgggcgatctgggagtgcgagtgcacgaagccctgcaggaagcggcccatcatcgcggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcgatgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggagagcgcgagttctcgttcaccacgactatttcttcttcttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaacaacaagcatggagactcagccatcgtcgccaacatcgccatctgcccccgccgccaccgccgacgagaaccagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagaacgagcagaaccaggctgggcacgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgtgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagttcggacgagggcaagcccgtggtcagcgacgagcagctggcgcgctggctgggagcgagtancaccccccagagcctggaagagcggcgcaagctcatgatggccgtggtcctggtgaccgtggagctggagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctggagtgccactgccgctgcaacctctgcacgccgcaccgctccctggcctgcaacccccagctgctgagcgagacccagatcatcggcaccttcgagttgcaaggccccggcgacggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttccgaaccccaccacccagaccggtaagaaggagcggcagggatacaagtcctggcgggggcacaaaaacgccatcgtctcctgcttgcaagcctgcgggggcaacatctccttcacccggcgctacctgctctttcaccgcggggtgaacttcccccgcaacatcttgcattactaccgtcacctccacagcccctactactgtttccaagaagaggcagaaacccagcagcagcagaaaaccagcggcagcagcagctagaaaatccacagcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtntacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccagcccacggagtgcggatcatcgtcgaagggggcctcgactcccacctgcttcggatcttcagccagcgaccgatcctggtcgagcgcgaacaaggacagacccttcttactttgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcaggaccctgccatcacaccttccacctgatcccgaataccacagcgccgctccccgctactaacaaccaaactacccaccaacgccaccgtcgcgacctttcctctgaatctaataccactaccggaggtgagctccgaggtcgaccaacctctgggatttactacggcccctgggaggtggtggggttaatagcgctaggcctagttgcgggtgggcttttggttctctgctacctatacctcccttgctgttcgtacttagtggtgctgtgttgctggtttaagaaatggggaagatcaccctagtgagctgcggtgcgctggtggcggtgttgctttcgattgtgggactgggcggcgcggctgtagtgaaggagaaggccgatccctgcttgcatttcaatcccaacaaatgccagctgagttttcagcccgatggcaatcggtgcgcggtactgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcgcacatgtgcaacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgagaaagagaaacagccataacacgttttttcacacaccttgtttttacagacaatgcgtctgttaaattttttaaacattgtgctcagtattgcttatgcctctggttatgcaaacatacagaaaaccctttatgtaggatctgatggtacactagagngtacccaatcacaagccaaggttgcatggtatttttatagaaccaacactgatccagttaaactttgtaagggtgaattgccgcgtacacataaaactccacttacatttagttgcagcaataataatcttacacttttttcaattacaaaacaatatactggtacttattacagtacaaactttcatacaggacaagataaatattatactgttaaggtagaaaatcctaccactcctagaactaccaccaccaccactactgcaaagcccactgtgaaaactacaactaggaccaccacaactacagaaaccaccaccagcacaacacttgctgcaactacacacacacacactaagctaaccttacagaccactaatgatttgatcgccctgctgcaaaagggggataacagcaccacttccaatgaggagatacccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggcctttttagtttttctatcattacctctgctctttgtgaatcagtggatagagatgttactattaccactggttctaattatacactgaaagggccaccctcaggtatgctttcgtggtattgctattttggaactgacactgatcaaactgaattatgcaattttcaaaaaggcaaaacctcaaactctaaaatctctaattatcaatgcaatggcactgatctgatactactcaatgtcacgaaagcatatggtggcagttattattgccctggacaaaacactgaagaaatgattttttacaaagtggaagtggttgatcccactacaccacccaccaccacaactattcataccacacacacagaacaaacaccagaggcaacagaagcagagttggccttccaggttcacggagattcctttgctgtcaatacccctacacccgatcagcggtgtccggggccgctagtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttaatagtaaaattaccagagttagctttattaaacatgttaatgtaactgaaggagataacatcacactagcaggtgtagaaggtgctcaaaacaccacctggacaaaataccatctaggatggagagatatttgcacctggaatgtaacttattattgcataggagttaatcttaccattgttaacgctaaccaatctcagaatgggttaattaaaggacagagtgttagtgtgaccagtgatgggtactatacccagcatagttttaactacaacattactgtcataccactgcctacgcctagcccacctagcactaccacacagacaaccacatacagtacatcaaatcagcctaccaccactacagcagcagaggttgccagctcgtctggggtccgagtggcatttttgatgttggccccatctagcagtcccactgctagtaccaatgagcagactactgaatttttgtccactgtcgagagccacaccacagctacctccagtgccttctctagcaccgccaatctctcctcgctttcctctacaccaatcagccccgctactactcctagccccgctcctcttcccactcccctgaagcaaacagacggcggcatgcaatggcagatcaccctgctcattgtgatcgggttggtcatcctggccgtgttgctctactacatcttctgccgccgcattcccaacgcgcaccgcaagccggcctacaagcccatcgttatcgggcagccggagccgcttcaggtggaagggggtctaaggaatcttctcttctcttttacagtatggtgattgaantatgattcctagacaattcttgatcactattcttatctgcctcctccaagtctgtgccaccctcgctctggtggccaacgccagtccagactgtattgggcccttcgcctcctacgtgctctttgccttcgtcacctgcatctgctgctgtagcatagtctgcctgcttatcaccttcttccagttcattgactggatctttgtgcgcatcgcctacctgcgccaccacccccagtaccgcgaccagcgagtggcgcagctgctcaggctcctctgataagcatgcgggctctgctacttntcgcgcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcatcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgatttaaataaaaaaaataatcatttgatttgaaataaagatacaatcatattgatgatttgagtttaacaaaaataaagaatcacttacttgaaatctgataccaggtctctgtccatgttttctgccaacaccacctcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggctgaccccgtcaccaccaagaacggggaaatcaccctcaagctgggagagggggtggacctcgactcgtcgggaaaactcatctccaacacggccaccaaggccgccgcccctctcagtatttcaaacaacaccatttcccttaaaactgctgcccctttctacaacaacaatggaactttaagcctcaatgtctccacaccattagcagtatttcccacatttaacactttaggcataagtcttggaaacggtcttcagacttcaaataagttgttgactgtacaactaactcatcctcttacattcagctcaaatagcatcacagtaaaaacagacaaagggctatatattaactccagtggaaacagaggacttgaggctaatataagcctaaaaagaggactagtttttgacggtaatgctattgcaacatatattggaaatggcttagactatggatcttatgatagtgatggaaaaacaagacccgtaattaccaaaattggagcaggattaaattttgatgctaacaaagcaatagctgtcaaactaggcacaggtttaagttttgactccgctggtgccttgacagctggaaacaaacaggatgacaagctaacactttggactacccctgacccaagccctaattgtcaattactttcagacagagatgccaaatttactctctgtcttacaaaatgcggtagtcaaatactaggcactgtggcagtggcggctgttactgtaggatcagcactaaatccaattaatgacacagtcaaaagcgccatagttttccttagatttgattccgatggtgtactcatgtcaaactcatcaatggtaggtgattactggaactttagggagggacagaccactcaaagtgtagcctatacaaatgctgtgggattcatgccaaatataggtgcatatccaaaaacccaaagtaaaacacctaaaaatagcatagtcagtcaggtatatttaactggagaaactactatgccaatgacactaaccataactttcaatggcactgatgaaaaagacacaaccccagttagcacctactctatgacttttacatggcagtggactggagactataaggacaaaaatattacctttgctaccaactcattctctttttcctacatcgcccaggaataatcccacccagcaagccaaccccttttcccaccacctttgtctatatggaaactctgaaacagaaaaataaagttcaagtgttttattgaatcaacagttttacaggactcgagcagttatttttcctccaccctcccaggacatggaatacaccaccctctccccccgcacagccttgaacatctgaatgccattggtgatggacatgcttttggtctccacgttccacacagtttcagagcgagccagtctcggatcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggttcgggtccagggactccctcagcatgatgcccacggccctcagcatcagtcgtctggtgcggcgggcgcagcagcgcatgcgaatctcgctcaggtcactgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaagacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccggatcccggcaatgacaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttctcgaccgtgtcatgatgcagttgctttcggacattttcgtacttgctgtagcagaacctggtccgggcgctgcacaccgatcgccggcggcggtctcggcgcttggaacgctcggtgttaaagttgtaaaacagccactctctcagaccgtgcagcagatctagggcctcaggagtgatgaagatcccatcatgcctgatagctctgatcacatcgaccaccgtggaatgggccaggcccagccagatgatgcaattttgttgggtttcggtgacggcgggggagggaagaacaggaagaaccatgattaacttttaatccaaacggtctcggagcacttcaaaatgaaggtcacggagatggcacctctcgcccccgctgtgttggtggaaaataacagccaggtcaaaggtgatacggttctcgagatgttccacggtggcttccagcaaagcctccacgcgcacatcagaaacaagacaatagcgaaagcgggagggttctctaattcctcaaccatcatgttacactcctgcaccatccccagataattttcatttttccagccttgaatgattcgaactagttcctgaggtaaatccaagccagccatgataaaaagctcgcgcagagcaccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcgtctccgaaatttttagccataggacccccaggaataagagaagggcaagccacattacagataaaccgaagtcccccccagtgagcattgccaaatgtaagattgaaataagcatgctggctagacccggtgatatcttccagataactggacagaaaatcgggtaagcaatttttaagaaaatcaacaaaagaaaaatcttccaggtgcacgtttagggcctcgggaacaacgatggagtaagtgcaaggggtgcgttccagcatggttagttagctgatctgtaaaaaaacaaaaaataaaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgagaagaagcatacaccccccggaacattggagtccgtgagtgaaaaaaagcggccgaggaagcaatgaggcactacaacgctcactctcaagtccagcaaagcgatgccatgcggatgaagcacaaaattttcaggtgcgtaaaaaatgtaattactcccctcctgcacaggcagcgaagctcccgatccctccagatacacatacaaagcctcagcgtccatagcttaccgagcggcagcagcagcggcacacaacaggcgcaagagtcagagaaaagactgagctctaacctgtccgcccgctctctgctcaatatatagccccagatctacactgacgtaaaggccaaagtctaaaaatacccgccaaataatcacacacgcccagcacacgcccagaaaccggtgacacactcagaaaaatacgcgcacttcctcaaacggccaaactgccgtcatttccgggttcccacgctacgtcatcaaaacacgactttcaaattccgtcgaccgttaaaaacatcacccgccccgcccctaacggtcgccgctcccgcagccaatcaccttcctccctccccaaattcaaacagctcatttgcatattaacgcgcaccaaaagtttgaggtatattattgatgatgg

SEQ ID NO: 4 - DNA, 36535 bp, Chimpanzee Pan 7 (CV33) Genomic
catcatcaataatatacctcaaacttttggtgcgcgttaatatgcaaatgagctgtttgaatttggggagggaggaaggtgattggccgagagacgggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtaggcgtcagctgatcgccagggtatttaaacctgcgctctctagtcaagaggccactcttgagtgccagcgagtagagttttctcctccgcgccgcgagtcagatctacactttgaaagatgaggcacctgagagacctgcccggtaatgttttcctggctactgggaacgagattctggaattggtggtggacgccatgatgggtggcgaccctcctgagccccctaccccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcatcgaaccagggagtgaaagctgcgggcgaaagctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttgggaaggcagagggtgactgggtgctgactggtttatttatgtatatgtttttttatgtgtaggtcccgtctctgacgtagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgactcaggggtggggactgtgggtatataagcaggtgcagacctgtgtggtcagttcagagcaggactcatggagatctggacggtcttggaagactttcaccagactagacagctgctagagaactcatcggagggggtctcttacctgtggagattctgcttcggtgggcctctagctaagctagtctatagggccaaacaggattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggatcgagaagagaacccgagagccggtctggaccctccggtggcggaggaggaggagtagctgacttgtttcccgagctgcgccgggtgctgactaggtcttccagtggacgggagagggggattaagcgggagaggcatgaggagactagccacagaactgaactgactgtcagtctgatgagccgcaggcgcccagaatcggtgtggtggcatgaggttcagtcgcaggggatagatgaggtctcggtgatgcatgagaaatattccctggaacaagtcaagacttgttggttggagcctgaggatgattgggaggtagccatcaggaattatgccaagctggctctgaagccagacaagaagtacaagattaccaaactgattaatatcagaaattcctgctacatttcagggaatggggccgaggtggagatcagtacccaggagagggtggccttcagatgttgtatgatgaatatgtacccgggggtggtgggcatggagggagtcacctttatgaacgcgaggttcaggggtgatgggtataatggggtggtctttatggccaacaccaagctgacagtgcacggatgctccttctttgggttcaataacatgtgcatcgaggcctggggcagtgtttcagtgaggggatgcagcttttcagccaactggatgggggtcgtgggcagaaccaagagcaaggtgtcagtgaagaaatgcctgttcgagaggtgccacctgggggtgatgagcgagggcgaagccaaagtcaaacactgcgcctctactgagacgggctgctttgtgctgatcaagggcaatgcccaagtcaagcataacatgatctgtggggcctcggatgagcgcggctaccagatgctgacctgcgccggtgggaacagccatatgctggccaccgtgcatgtgacctcgcacccccgcaagacatggcccgagttcgagcacaacgtcatgacccgatgcaatgtgcacctggggtcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcttgtatgaggggcagaatgactaaaatctgtgtttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgacttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggtcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcgggccggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggctggcataacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcagaagctcggggtcgaagtagctgatgcaggtgtccagatcgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgtgcggccttgcgcagggaggtgtgggtgagggcgaaggtgtcgcgcaccatgaccttgaggaactggtgcttgaagtcgaggtcgtcgcagccgccctgctcccagagctggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttaacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacttcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgccggtcagaagcggcggcgaggacgcgcgccgggcggcaggggcggctcgggacccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcagcgatggtggcgcgcacctcgcgctcgaaggccccggggggctcctcttcttccatctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcggggatttcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctgtatctgggtgagggtggtctggaagtcgtcgaagtcgacgaagcggtggtaggctccggtgttgatggtataggagcagttggccatgacggaccagttgacggtctggtggccgggtcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcgaccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccacctcaaccgcccctaccgccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggctatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgctcgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccgccaccaccgtgtggaagaaagagggcggggaccggcggccgtcctcggcgctgtccggtcgcgcgggtgctgccgcggcggtgcctgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcacccgtagacgccagcgacacgacaggcagcggggtctggtgtgggacgatgaggattccgccgacgacagcagcgtgttggacttgggtgggagtggtggtggtaacccgttcgctcacttgcgcccccgtatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaatggggtcgcggtggatgagaattatgatggtagtcaggacgagctgacttacgagtgggtggagtttgagctgcccgagggcaacttctcggtgaccatgaccatcgatctgatgaacaacgccatcatcgacaactacttggcggtggggcgtcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctatgagaaaagcaaggaggaggccgccgcagcggcgaccgcagccgtggccaccgcctctaccgaggtgcggggcgataattttgctagcgccgcggcagtggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgcctccaccgtggacgccgtcatcgacagcgtggtggccgatgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggtgaaggaggaaagaaagccccgcaaactgaagcgggtcaaaaaggacaaaaaggaggaggaagatgtggacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcttccaccactcgccgaagacgcaagtacggcgcggccagcctgctgatgcccaactacgcgctgcatccttccatcatccccacgccgggctaccgcggcacgcgcttctaccgcggctacaccagcagccgccgcaagaccaccacccgccgccgccgtcgtcgcacccgccgcagcagcaccgcgacttccgccgccgccctggtgcggagagtgtaccgcagcgggcgcgagcctctgaccctgccgcgcgcgcgctaccacccgagcatcgccatttaactctgccgtcgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcgggggcccagcttcaaaccctactccggcaccgcctacaacagcctggctcccaagggagcgcccaacacttgccagtggacatataaagctggtgatactgatacagaaaaaacctatacatatggaaatgcacctgtgcaaggcattagcattacaaaggatggtattcaacttggaactgacagcgatggtcaggcaatctatgcagacgaaacttatcaaccagagcctcaagtgggtgatgctgaatggcatgacatcactggtactgatgaaaaatatggaggcagagctcttaagcctgacaccaaaatgaagccttgctatggttcttttgccaagcctaccaataaagaaggaggccaggcaaatgtgaaaaccgaaacaggcggtaccaaagaatatgacattgacatggcattcttcgataatcgaagtgcagctgccgccggcctagccccagaaattgttttgtatactgagaatgtggatctggaaactccagatacccatattgtatacaaggcaggtacagatgacagtagctcttctatcaatttgggtcagcagtccatgcccaacagacccaactacattggcttcagagacaactttatcggtctgatgtactacaacagcactggcaatatgggtgtactggctggacaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaatcacggtgtggaggatgaacttcctaactattgcttccccctggatgctgtgggtagaactgatacttaccagggaattaaggccaatggtgataatcaaaccacctggaccaaagatgatactgttaatgatgctaatgaattgggcaagggcaatcctttcgccatggagatcaacatccaggccaacctgtggcggaacttcctctacgcgaacgtggcgctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgataccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagcctcttgcttcttgcaagatgacggcctgcgcgggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaatccggtgtgtgtatgtgaatgctttattcatcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccagcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcggaatgccgcggtgctcctcgttcacatacaggtggcagatacggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgttgtcatcttagtcgccgccgccgaagtcagggggtcgttctcgtccagggtctcaaacactcgcttgccgtccttctcggtgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgccgacgagaaccagcagcagcagaatgaaagcttaaccgccccgccgcccagccccacctccgacgccgcagccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagagcagtcaggcagaggaggaggagatggaagactgggacagcactcaggcagaggaggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcagacacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggacagcctgcaagacagtctggaggaggaagacgaggtggaggaggcagaggaagaagcagccgccgccagaccgtcgtcctcggcggaggaggagaaagcaagcagcacggataccatctccgctccgggtcggggtcgcggcggccgggcccacagtagatgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagcagcagaaaaccagcggcagcagctagaaaatccacagcggcggcaggtggactgaggatcgcggcgaacgagccggcgcagacccgggagctgaggaaccggatctttcccaccctctatgccatcttccagcagagtcgggggcaagagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggtctcgactcccacctgcttcggatcttcagccagcgtccgatcctggccgagcgcgagcaaggacagacccttctgaccctgtactgcatctgcaaccaccccggcctgcatgaaagtctttgttgtctgctgtgtactgagtataataaaagctgagatcagcgactactccggacttccgtgtgttcctgctatcaaccagtccctgttcttcaccgggaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgacctttcctctgggtctaataccactaccggaggtgagctccgaggtcgaccaacctctgggatttactacggcccctgggaggtggtagggttaatagcgctaggcctagttgcgggtgggcttttggctctctgctacctatacctcccttgctgttcgtacttagtggtgctgtgttgctggtttaagaaatggggaagatcaccctagtgagctgcggtgtgctggtggcggtggtgctttcgattgtgggactgggcggcgcggctgtagtgaaggagaaggccgatccctgcttgcatttcaatcccgacaaatgccagctgagttttcagcccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcgcacatgtgcgacacggtcatgtggatgagcaagcagtacgatatgtggccccccacgaaggagaacatcgtggtcttctccatcgcttacagcgtgtgcacggcgctaatcaccgctatcgtgtgcctgagcattcacatgctcatcgctattcgccccagaaataatgccgaaaaagaaaaacagccataacacgttttttcacacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcatttcggacatggaattttatcaagtttctgtgtctgaacccaccacgcctagaatgaccacaaccacaaaaactacacctgttaccactatacagctcactaccaatggctttcttgccatgcttcaagtggctgaaaatagcaccagcattcaacccaccccacccagtgaggaaattcccagatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttagttttttctatcattacctctgctctatgcaattctgacaatgaggacgttactgtcgttgtcggatcaaattatacactaaaaggtccagcaaaaggtatgctttcgtggtattgttggttcggaactgacgagcaacagacagaactttgcaatgctcaaaaaggcaaaacctcaaattctaaaatctctaattatcaatgcaatggcactgacttagtattgctcaatgtcacgaaagcatatgctggcagttacacctgccctggagatgatgccgacaatatgattttttacaaagtggaagtggttgatcccactactccaccgcccaccaccacaactactcataccacacacacagaacaaacaccagaggcagcagaagcagagttggccttccaggttcacggagattcctttgctgtcaatacccctacacccgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttagtgctgggtttttgaaaaatcttaccatttatgaaggtgagaatgccactctagtgggcatcagtggtcaaaatgtcagctggctaaaataccatctagatgggtggaaagacatttgcgattggaatgtcactgtgtatacatgtaatggagttaacctcaccattactaatgccacccaagatcagaatggtaggtttaagggccagagtttcactagaaataatgggtatgaatcccataacatgtttatctatgacgtcactgtcatcagaaatgagactgccaccaccacacagatgcccactacacacagttctaccactactaccatgcaaaccacacagacaaccactacatcaactcagcatatgaccaccactacagcagcaaagccaagtagtgcagcgcctcagccccaggctttggctttgaaagctgcacaacctagtacaactactaggaccaatgagcagactactgaatttttgtccactgtcgagagccacaccacagctacctccagtgccttctctagcaccgccaatctctcctcgctttcctctacaccaatcagtcccgctactactcccaccccagctcttctccccactcccctgaagcaaactgaggacagcggcatgcaatggcagatcaccctgctcattgtgatcgggttggtcatcctggccgtgttgctctactacatcttctgccgccgcattcccaacgcgcaccgcaaaccggcctacaagcccatcgttatcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggctcctctgataagcatgcgggctctgctacttctcgcgcttctgctgttagtgctcccccgccccgtcgacccccggtcccccactcagtcccccgaagaggtccgcaaatgcaaattccaagaaccctggaaattcctcaaatgctaccgccaaaaatcagacatgcttcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcaccccgaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaatatcatattgatgatgatttaaataaaaaataatcatttgatttgaaataaagatacaatcatattgatgatttgagttttaaaaaataaagaatcacttacttgaaatctgataccaggtctctgtccatgttttctgccaacaccacctcactcccctcttcccagctctggtactgcagaccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgactggctgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctctttataccaaagatggaaaattatccttacaagtttctccaccgttaaacatattaaaatcaaccattctgaacacattagctgtagcttatggatcaggtttaggactgagtggtggcactgctcttgcagtacagttggcctctccactcacttttgatgaaaaaggaaatattaaaattaacctagccagtggtccattaacagttgatgcaagtcgacttagtatcaactgcaaaagaggggtcactgtcactacctcaggagatgcaattgaaagcaacataagctggcctaaaggtataagatttgaaggtaatggcatagctgcaaacattggcagaggattggaatttggaaccactagtacagagactgatgtcacagatgcatacccaattcaagttaaattgggtactggccttacctttgacagtacaggcgccattgttgcttggaacaaagaggatgataaacttacattatggaccacagccgacccctcgccaaattgcaaaatatactctgaaaaagatgccaaactcacactttgcttgacaaagtgtggaagtcaaattctgggtactgtgactgtattggcagtgaataatggaagtctcaacccaatcacaaacacagtaagcactgcactcgtctccctcaagtttgatgcaagtggagttttgctaagcagctccacattagacaaagaatattggaacttcagaaagggagatgttacacctgctgagccctatactaatgctataggttttatgcctaacataaaggcctatcctaaaaacacatctgcagcttcaaaaagccatattgtcagtcaagtttatctcaatggggatgaggccaaaccactgatgctgattattacttttaatgaaactgaggatgcaacttgcacctacagtatcacttttcaatggaaatgggatagtactaagtacacaggtgaaacacttgctaccagctccttcaccttctcctacatcgcccaagaatgaacactgtatcccaccctgcatgccaacccttcccaccccactctgtctatggaaaaaactctgaagcacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtcccggcgcttggaacgctcggtgttgaaattgtaaaacagccactctctcagaccgtgcagcagatctagggcctcaggagtgatgaagatcccatcatgcctgatagctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaaggtcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctaagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcacccaggcaatttttaagaaaatcaacaaaagaaaaatcctccaggtgcacgtttagagcctcgggaacaacgatgaagtaaatgcaagcggtgcgttccagcatggttagttagctgatctgtaaaaaacaaaaaataaaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaatcctcaggtgcgtacaaaatgtaattactcccctcctgcacaggcagcgaagcccccgatccctccagatacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaactgccgtcatttccgggttcccacgctacgtcatcggaattcgactttcaaattccgtcgaccgttaaaaacgtcacccgccccgcccctaacggtcgcccgtctctcggccaatcaccttcctccctccccaaattcaaacagctcatttgcatattaacgcgcaccaaaagtttgaggtatattattgatgatg

SEQ ID NO: 5 - DNA, 32020 bp, Chimpanzee Pan 5 (CV23) Genomic
catcatcaataatatacctcaaacttttggtgcgcgttaatatgcaaatgaggtatttgaatttggggatgcggggcggtgattggctgcgggagcggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacggtgtcaaagtccggtgtttttacgtaggtgtcagctgatcgccagggtatttaaacctgcgctctctagtcaagaggccactcttgagtgccagcgagtagagttttctcctccgcgccgcgagtcagatctacactttgaaagatgaggcacctgagagacctgcccggtaatgttttcctggctactgggaacgagattctggaactggtggtggacgccatgatgggtgacgaccctccggagccccctaccccatttgaagcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgaaccagggagtgaaaacagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagctggggaggcagagggtgactgggtgctgactggtttatttatgtatatgttttttatgtgtaggtcccgtctctgacgtagatgagacccccactacagagtgcatttcatcacccccagaaattggcgaggaaccgcccgaagatattattcatagaccagttgcagtgagagtcaccgggcgtagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgactcaggggtggggactgtgggtatataagcaggtgcagacctgtgtggtcagttcagagcaggactcatggagatctggacagtcttggaagactttcaccagactagacagctgctagagaactcatcggagggagtctcttacctgtggagattctgcttcggtgggcctctagctaagctagtctatagggccaagcaggattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaccgagaagagaacctgagagccggtctggaccctccggtggcggaggaggaggagtagctgacttgtttcccgagctgcgccgggtgctgactaggtcttccagtggacgggagagggggattaagcgggagaggcatgaggagactagccacagaactgaactgactgtcagtctgatgagtcgcaggcgcccagaatcggtgtggtggcatgaggtgcagtcgcaggggatagatgaggtctcagtgatgcatgagaaatattccctagaacaagtcaagacttgttggttggagcccgaggatgattgggaggtagccatcaggaattatgccaagctggctctgaggccagacaagaagtacaagattaccaaactgattaatatcagaaattcctgctacatttcagggaatggggccgaggtggagatcagtacccaggagagggtggccttcagatgctgcatgatgaatatgtacccgggggtggtgggcatggagggagtcacctttatgaacgcgaggttcaggggtgatgggtataatggggtggtctttatggccaacaccaagctgacagtgcacggatgctccttctttggcttcaataacatgtgcattgaggcctggggcagtgtttcagtgaggggatgcagtttttcagccaactggatgggggtcgtgggcagaaccaagagcatggtgtcagtgaagaaatgcctgttcgagaggtgccacctgggggtgatgagcgagggcgaagccaaagtcaaacactgcgcctctaccgagacgggctgctttgtactgatcaagggcaatgccaaagtcaagcataatatgatctgtggggcctcggatgagcgcggctaccagatgctgacctgcgccggtgggaacagccatatgctagccaccgtgcatgtggcctcgcacccccgcaagacatggcccgagttcgagcacaacgtcatgacccgctgcaatgtgcacctggggtcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggactgggtgggagcctgcatgatgggcagaatgactaaaatctgtgtttttctgcgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcttgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgcccccaagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccaggggcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtctggccggtcggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagcttgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagcccggtgccgaggttggagcgctgcggcttttcggcgcggtagacgatctggcggaagatggcgtgggagttggaggagatggtgggcctctggaagatgttgaagtgggcgtggggcagtccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagctggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgaggccgtgctgctcgagggcccagtcggcgaggtgggggttggcgccgaggaaggaagtccagagatccacggccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacgtcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgaggccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggtgctggcggcggcggctccatgcttagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcgaccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcttcttccatctcctcctcctcttccatctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgttttggccattttcgtcaggccggaaatgaaactagtaagcgcggaaagcggccgtccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgcagcagcagcaacagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcctagccgccgggccttggaagctgccggcggttccccctacgtggaggaggtggacgatgaggaggaggagggcgagtacctggaagactgatggcgcgaccgtatttttgctagatgcagcaacagccaccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccgactctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccaccaccaccaccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcggccgcgcctgctgggcgaggaggagtacctgaacgactccttgcttcggcccgagcgcgagaagaacttccccaataacgggatagagagcctggtggacaagatgagccgctggaagacgtacgcgcacgagcacagggacgagccccgagctagcagcagcaccggcgccacccgtagacgccagcggcacgacaggcagcggggtctggtgtgggacgatgaggattccgccgacgacagcagcgtgttggacttgggtgggagtggtggtggtaacccgttcgctcacctgcgcccccgtatcgggcgcctgatgtaagaatctgaaaaaataaaagacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtcacagtaacagatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctgctggacgtggacgcctacgagaaaagcaaggaggatagcgccgccgcggcgaccgcagccgtggccaccgcctctaccgaggtgcggggcgataattttgctagcgccgcgacactggcagcggccgaggcggctgaaaccgaaagtaagatagtgatccagccggtggagaaggacagcaaggagaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgttcgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaattcaaggaagagatgctccaggtcatcgcgcctgagatctacggcccggcggcggtgaaggaggaaagaaagccccgcaaactgaagcgggtcaaaaaggacaaaaaggaggaggaagatgtggacggactggtggagtttgtgcgcgagttcgccccccggcggcgcgtgcagtggcgcgggcggaaagtgaaaccggtgctgcgacccggcaccacggtggtcttcacgcccggcgagcgttccggctccgcctccaagcgctcctacgacgaggtgtacggggacgaggacatcctcgagcaggcggccgaacgtctgggcgagtttgcttacggcaagcgcagccgccccgcgcccttgaaagaggaggcggtgtccatcccgctggaccacggcaaccccacgccgagcctgaagccggtgaccctgcagcaggtgctgcctggtgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcaccggcttccaccacccgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgccgtcgtcgcacccgccgcagcagcaccgcgacttccgccgccgccctggtgcggagagtgtaccgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatgcccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcggcccgtggcgcctctggccaccggggtgctgaaacccagcagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcttacaacagcctggctcccaagggagcgcccaacacttgccagtggacatataaagctgatggtgatactggtacagaaaaaacctatacatatggaaatgcgcctgtgcaaggcattagtattacaaaagatggtattcaacttggaactgacactgatgatcagcccatttatgcagataaaacttatcaaccagagcctcaagtgggtgatgctgaatggcatgacatcactggtactgatgaaaaatatggaggcagagctctcaagcctgacaccaaaatgaagccctgctatggttcttttgccaagcctaccaataaagaaggaggtcaggcaaatgtgaaaaccgaaacaggcggtaccaaagaatatgacattgacatggcattcttcgataatcgaagtgcagctgcggctggcctggccccagaaattgttttgtatactgagaatgtggatctggaaactccagatactcatattgtatacaaggcgggcacagatgacagcagctcttctatcaatttgggtcagcagtccatgcccaacagacccaactacattggctttagagacaactttatcgggctcatgtactacaacagcactggcaacatgggcgtgctggctggtcaggcctcccagctgaatgctgtggtggacttgcaggacagaaacactgaactgtcctaccagctcttgcttgactctctgggcgacagaaccaggtatttcagtatgtggaatcaggcggtggacagctatgaccccgatgtgcgcattattgaaaatcacggtgtggaggatgaactccctaactattgcttccccctggatgctgtgggtagaactgatacttaccagggaattaaggccaatggtgctgatcaaaccacctggaccaaagatgatactgttaatgatgctaatgaattgggcaagggcaatcctttcgccatggagatcaacatccaggccaacctgtggcggaacttcctctacgcgaacgtggcgctgtacctgcccgactcctacaagtacacgccggccaacatcacgctgccgaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagttcttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggacagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccccgctcttgcttcttgcaagatgacggcctgtgcgggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgtgaatgctttattcataataaacagcacatgtttatgccaccttttctgaggctctgactttatttagaaatcgaaggggttctgccggctctcggcgtgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcatcgcagcttgccctcggcctcggtgcacccgtgcagccacagcgcgcagccggtgcactcccagttcttgtgggcgatctgggagtgcgagtgcacgaagccctgcaggaagcggcccatcatcgtggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatgacttccatgcccttctcccaggccgagacgatcggcaggctcagggggttcttcaccgccgttgtcatcttagtcgccgccgctgaggtcagggggtcgttctcgtccagggtctcaaacactcgcttgccgtccttctcggtgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttcttcttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaacaagcatggagactcagccatcgtcgccaacatcgccatctgcccccgccgccgccgacgagaaccagcagcagaatgaaagcttaaccgccccgccgcccagccccacctccgacgccgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggtcccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtgctcaagcgcacggtcgagctgacccacttcgcctacccggcgctcaacctgccccccaaggtcatgagcgccgtcatggaccaggtgctcatcaagcgcgcctcgcccctctcggatgaggacatgcaggaccccgagagctcggacgagggcaagcccgtggtcagcgacgagcagctggcgcgctggctgggagcgagtagcaccccccagagcttggaagagcggcgcaagctcatgatggccgtggtcctggtgaccgtggagctggagtgtctgcgccgcttcttcgccgacgcagagaccctgcgcaaggtcgaggagaacctgcactacctcttcaggcacgggtttgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctgaaggccctgtggaccgggttcgacgagcgcaccaccgcctcggacctggccgacctcatcttccccgagcgcctgcggctgacgctgcgcaacggactgcccgactttatgagtcaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgaactgtcggcctgcgtcatcacccagggggccatcctggcccaattgcaagccatccagaaatcccgccaagaatttctgctgaaaaagggccacggggtctacctggacccccagaccggagaggagctcaaccccagcttcccccaggatgccccgaggaagcagcaagaagctgaaagtggagctgccgccgccggaggatttggaggaagactgggagagcagtcaggcagaggaggaggagatggaagactgggacagcactcaggcagaggaggacagcctgcaagacagtctggaagacgaggtggaggaggaggcagaggaagaagcagccgccgccagaccgtcgtcctcggcggagaaagcaagcagcacggataccatctccgctccgggtcggggtcgcggcgaccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccgccgctacctgctcttccaccgcggggtgaacttcccccgcaacatcttgcattactaccgtcacctccacagcccctactactgtttccaagaagaggcagaaacccagcagcagcagaaaaccagcggcagcagcagctagaaaatccacagcggcggcaggtggactgaggatcgcagcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagcgccgggcccgcgatgatctcacgggtgaatgacatccgcgcccgccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgtcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatttgagtttaataaaaataaagaatcacttacttgaaatctgataccaggtctctgtccatgttttctgccaacaccacttcactcccctcttcccagctctggtactgcaggccccggcgggctgcaaacttcctccacaccctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgtctggccgatcccgtcaccaccaagaacggggaaatcaccctcaagctgggagatggggtggacctcgactcctcgggaaaactcatctccaacacggccaccaaggccgccgcccctctcagtttttccaacaacaccatttcccttaacatggatacccctttttacaacaacaatggaaagttaggcatgaaagtcactgctccactgaagatactagacacagacttgctaaaaacacttgttgtagcttatggacaaggtttaggaacaaacaccactggtgcccttgttgcccaactagcatccccacttgcttttgatagcaatagcaaaattgcccttaatttaggcaatggaccattgaaagtggatgcaaatagactgaacatcaattgcaatagaggactctatgttactaccacaaaagatgcactggaagccaatataagttgggctaatgctatgacatttataggaaatgccatgggtgtcaatattgatacacaaaaaggcttgcaatttggcaccactagtaccgtcgcagatgttaaaaacgcttaccccatacaaatcaaacttggagctggtctcacatttgacagcacaggtgcaattgttgcatggaacaaagatgatgacaagcttacactatggaccacagccgacccctctccaaattgtcacatatattctgaaaaggatgctaagcttacactttgcttgacaaagtgtggcagtcagattctgggcactgtttccctcatagctgttgatactggcagtttaaatcccataacaggaacagtaaccactgctcttgtctcacttaaattcgatgcaaatggagttttgcaaagcagctcaacactagactcagactattggaatttcagacagggagatgttacacctgctgaagcctatactaatgctataggtttcatgcccaatctaaaagcataccctaaaaacacaagtggagctgcaaaaagtcacattgttgggaaagtgtacctacatggggatacaggcaaaccactggacctcattattactttcaatgaaacaagtgatgaatcttgcacttactgtattaactttcaatggcagtggggggctgatcaatataaaaatgaaacacttgccgtcagttcattcaccttttcctatattgctaaagaataaaccccactctgtaccccatctctgtctatggaaaaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgtcgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgccccctccagaacacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccgacaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgttatgatgcagttgctttcggacattttcgtacttgctgtagcagaacctggtccgggcgctgcacaccgatcgccggcggcggtcccggcgcttggaacgctcggtgttgaagttgtaaaacagccactctctcagaccgtgcagcagatctagggcctcaggagtgatgaagatcccatcatgcctgatggctctaatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctaagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtgcacgtttagagcctcgggaacaacgatggagtaaatgcaagcggtgcgttccagcatggttagttagctgatctgtagaaaaaaacaaaaatgaacattaaaccatgctagcctggcgaacaggtgggtaaatcgttctctccagcaccaggcaggccacggggtctccggcacgaccctcgtaaaaattgtcgctatgattgaaaaccatcacagagagacgttcccggtggccggcgtgaatgattcgacaagatgaatacacccccggaacattggcgtccgcgagtgaaaaaaagcgcccaaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaactgccgtcatttccgggttcccacgctacgtcatcaaaattcgactttcaaattccgtcgaccgttaaaaacgtcgcccgccccgcccctaacggtcgccgctcccgcagccaatcaccgccccgcatccccaaattcaaatacctcatttgcatattaacgcgcaccaaaagtttgaggtatattattgatgatg

SEQ ID NO: 6 - DNA, 1737 bp, Chimpanzee Adenovirus- ChAd 20 Fiber
atgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagctcaccttgtggaccacaccagacccatctcctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaataa

SEQ ID NO: 7 - DNA, 1278 bp, Chimpanzee Adenovirus- ChAd 4 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatga

SEQ ID NO: 8 - DNA, 1335 bp, Chimpanzee Adenovirus- ChAd 5 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgtctggccgatcccgtcaccaccaagaacggggaaatcaccctcaagctgggagatggggtggacctcgacgactcgggaaaactcatctccaacacggccaccaaggccgccgcccctctcagtttttccaacaacaccatttcccttaacatggatacccctctttacaacaacaatggaaagctaggtatgaaggtaaccgcaccattaaagatattagacacagatctactaaaaacacttgttgttgcttatgggcagggattaggaacaaacaccaatggtgctcttgttgcccaactagcatacccacttgtttttaataccgctagcaaaattgcccttaatttaggcaatggaccattaaaagtggatgcaaatagactgaacattaattgcaaaagaggtatctatgtcactaccacaaaagatgcactggagattaatatcagttgggcaaatgctatgacatttataggaaatgccattggtgtcaatattgacacaaaaaaaggcctacagttcggcacttcaagcactgaaacagatgttaaaaatgctttttcactccaagtaaaacttggagctggtcttacatttgacagcacaggtgccattgttgcttggaacaaagaagatgacaaacttacactgtggaccacagccgatccatctccaaactgtcacatatattctgcaaaggatgctaagcttacactctgcttgacaaagtgtggtagtcaaatcctaggcactgtctccctattagcagtcagtggcagcttggctcctatcacaggggctgttagaactgcacttgtatcactcaaattcaatgctaatggagcccttttggacaaatcaactctgaacaaagaatactggaactacagacaaggagatctaattccaggtacaccatatacacatgctgtgggtttcatgcctaacaaaaaagcctaccctaaaaacacaactgcagcttccaagagccacattgtgggtgatgtgtatttagatggagatgcagataaacctttatctcttatcatcactttcaatgaaactgatgatgaaacctgtgattactgcatcaactttcaatggaaatggggagctgatcaatataaggataagacactcgcaaccagttcattcaccttctcatacatcgcccaagaataa

SEQ ID NO: 9 - DNA, 1338 bp, Chimpanzee Adenovirus- ChAd 7 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgactggccgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctttttacaacaataatggaaagttaggcatgaaagtcactgctccactgaagatactcgacacagacttgctaaaaacacttgttgtagcttatggacaaggtttaggaacaaacaccactggtgcccttgttgcccaactagcagccccacttgcttttgatagcaatagcaaaattgcccttaatttaggcaatggaccattgaaagtggatgcaaatagactgaacatcaattgcaatagaggactctatgttactaccacaaaagatgcactggaaaccaacataagttgggctaatgctatgacatttataggaaatgccatgggtgtcaatattgatacacaaaaaggcttgcaatttggcaccactagtaccgtcgcagatgttaaaaacgcttaccccatacaagtcaaactgggagctggtctcacatttgacagcacaggtgcaattgtcgcttggaacaaagaagatgacaaacttacactgtggaccacagccgatccatctccaaactgtcacatatattctgacaaggatgctaagcttacactctgcttgacaaagtgtggcagtcagatactgggcactgtttctctcatagctgttgatactggtagcttaaatccaataacaggacaagtaaccactgctcttgtttcacttaaattcgatgccaatggagttttgcaaaccagttcaacattggacaaagaatattggaattttagaaaaggagatgtgacacctgctgagccatatactaatgctataggtttcatgcccaatctaaaggcataccctaaaaacacaagtggagctgcaaaaagtcacattgttgggaaagtgtacctacatggggatacagacaaaccactggacctgattattactttcaatgaaacaagtgatgaatcttgcacttactgtattaactttcaatggaaatgggatagtactaagtacacaggtgaaacacttgctacaagctccttcaccttctcctacattgcccaagaatga

SEQ ID NO: 10 - DNA, 1278 bp, Chimpanzee Adenovirus- ChAd 9 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgactcctcgggaaaactcatctccaacacggccaccaaggccgctgcccctctcagtttttccaacaacaccatttcccttaacatggatcaccccttttacactaaagatggaaaattagccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgtcgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggagacctaaaccccattactggcaccgtaagcagtgctcaggtgtttctacgttttgatgcaaacggtgttcttttaacagaacattctacactaaaaaaatactgggggtataggcagggagatagcatagatggcactccatatgccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggagctaactcttataccttctcctacatcgcccaagaatga

SEQ ID NO: 11 - DNA, 1278 bp, Chimpanzee Adenovirus- ChAd 10 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgactggccgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcgccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatga

SEQ ID NO: 12 - DNA, 1737 bp, Chimpanzee Adenovirus- ChAd 11 Fiber
atgaagcgcaccaaaacgtctgacgagagcttcaaccccgtgtacccctatgacacggaaaacggtcctccctccgtccctttcctcacccctcccttcgtgtctcccgatggattccaagagagcccccccggggtcctgtctctgaacctggccgagcccctggtcacttcccacggcatgctcgccctgaaaatgggaagtggcctctccctggacgacgccggcaacctcacctctcaagatgtcaccaccactacccctcccctgaaaaaaaccaagaccaacctcagcctagaaacctcagcccccctgactgtgagcacctcaggcgccctcaccctagcagccgccgttcccctggcggtggccggcacctccctcaccatgcaatcagaggcccccctgacagtccaagatgcaaaactcaccctggccaccaagggccccctgaccgtgtctgaaggcaaactagccttgcagacctcggccccgctgacggccgctgacagcagcaccctcacaatcagcgccacaccgccccttagcacaagcaatggcagcttgggtattgacatgcaagcccccatttacactactaacggaaaactgggacttaactttggtgctcccctgcatgtggtagacagcctaaatgcactgactgtagtgactggccaaggtcttacgataaacggtacagccctacaaactagagtctcaggtgccctcaactatgactcatcaggaaacctagaattgagagctgcagggggtatgcgagttgatgcaaatggcaaacttatccttgacgtagcttacccatttgatgctcaaaacaacctcagccttagacttggacagggacccctgtttgttaactctgcccacaacttggatgttaactacaacagaggcctctacctgttcacatctggaaataccaaaaagctagaagttaatatcaaaacagccaaaggcctcatttatgatgacactgctatagcaatcaatccaggcgatgggctagagtttggctcaggctcagatacaaatccattaaaaactaaacttggattgggactagagtatgactccagcagagccataattgctaagctgggaaccggcctaagctttgacaacacaggtgccatcacagtgggcaacaaaaatgatgacaagcttaccttgtggaccacaccagacccctctcccaactgtagaatttattcagaaaaagatgctaaatttacactagttttaactaaatgcggcagtcaggtgttggccagcgtttctgttttatctgtaaaaggcagccttgcgcccatcagtggcacagtaactagcgctcagattattctcagatttgatgaaaatggagttctactaagcaattcttctcttgacccccaatactggaactacagaaaaggtgaccttacagagggcactgcatataccaacgcagtgggatttatgcccaacctcacagcatacccaaaaacacagagtcaaactgctaaaagcaacattgtaagccaggtttacttgaatggggacaaatccaaacccatgatcctcaccattaccctcaatggaactaatgaaacaggggatgctacagttagcacttactccatgtcattctcatggaattggaatggaagtaattacattaatgaaacgttccaaaccaactctttcaccttctcctacatcgcccaagaataa

SEQ ID NO: 13 - DNA, 1632 bp, Chimpanzee Adnovirus- ChAd 16 Fiber
atgaagcgcaccaaaacgtctgacaagagcttcaaccccgtgtacccctatgacacggaaaacggtcctccctccgtccctttcctcacccctcccttcgtgtctcccgatggattccaagagagcccccccggggtcctgtctctgaacctggccgagcccctggtcacttcccacggcatgctcgccctgaaaatgggaagtggcctctccctggacgacgccggcaacctcacctctcaagatgtcaccaccactacccctcccctgaaaaaaaccaagaccaacctcagcctagaaacctcagcccccctgactgtgagcacctcaggcgccctcaccctagcagccgccgcccccctggcggtggccggcacctccctcaccatgcaatcagaggcccccctgacagtccaagatgcaaaactcaccctggccaccaagggccccctgaccgtgtctgaaggcaaactggccttgcagacctcggccccgctgacggccgctgacagcagcaccctcaccgttagcgccacaccacccatcagtgtaagcagtggaagtttgggcttagacatggaagacccaatgtatactcatgatggaaaactgggaataagaattgggggcccactgagagtagtagacagcctgcacacactgactgtagttaccggaaatggaatagctgtagataacaatgccctccaaactagagttacgggcgccctgggttatgacacatcaggaaacctacaactgagagccgcggggggtatgcgaattgatgcaaatggccaacttatccttgatgtggcatacccatttgatgctcaaaacaatctcagccttagacttggtcagggacccctgtatgtaaacacagaccacaacctagatttgaattgcaacagaggtctgaccacaactaccaccaacaacacaaaaaaacttgaaactaaaattggctcaggcttagactatgataccaatggtgctgttattattaaacttggcactggtgtcagctttgacagcacaggtgccctaagtgtgggaaacactggcgatgataaactgactctgtggacaaccccagacccatctccaaattgcagaattcactcagacaaagactgcaagtttactctagtcctaactaagtgtggaagtcaaatcctggcttctgtcgccgccctagcggtgtcaggaaatctggcttcaataacaggcaccgtttccagcgttaccatctttctcagatttgatcagaatggagtgcttatggaaaactcctcgctagacaagcagtactggaacttcagaaatggtaattcaaccaatgccaccccctacaccaatgcagttgggtttatgccaaacctcgcagcataccccaagacacagagccagactgcaaaaaacaacattgtaagtcaggtttacttgaatggggacaaatccaaacccatgacccttaccattaccctcaatggaactaatgaatccagtgaaactagccaggtgagtcactactccatgtcatttacgtgggcttgggagagtgggcaatatgccaccgaaacctttgccaccaattcctttaccttctcttacattgctgaacaataa

SEQ ID NO: 14 - DNA, 1632 bp, Chimpanzee Adenovirus-ChAd 17 Fiber
atgaagcgcaccaaaacgtctgacgagagcttcaaccccgtgtacccctatgacacggaaagcggccctccctccgtccctttcctcacccctcccttcgtgtctcccgatggattccaagaaagcccccccggggtcctgtctctgaacctggccgagcccctggtcacttcccacggcatgcttgccctgaaaatgggaagtggcctctccctggacgacgctggcaaccttacctctcaagatattacctccactacccctcccctcaaaaaaaccaagaccaacctcagcctagaaacctcatcccccctaactgtaagcacctcaggcgccctcaccgtagcagccgccgctcccctggcggtggccggcacctccctcaccatgcaatcagaggcccccctggcagtacaggatgcaaaactcaccctggccaccaaaggccccctgaccgtgtctgaaggcaaactggccttgcaaacatcggccccgctgacggccgctgacagcagcaccctcaccgttagctccactccaccaattagtgtaagcagtggaagtttgggcttggacatggaagaccccatgtatactcacgatggaaaactgggaataagaattgggggtccactaagagtagtagacagcttgcacacactcactgtagttaccggaaatggactaactgtagataacaatgccctccaaactagagttacgggcgccctaggttatgacacatcaggaaatctacaactgagagccgcagggggtatgcgaattgatgcaaatggccaacttatccttgatgtggcatacccatttgatgctcaaaacaatctcagccttagacttggtcagggacccctgtatgtaaatacagaccacaacctggatttaaattgcaacagaggtctaaccacaactaccaccaacaacacaaaaaaacttgagactaaaattagctcaggcttagactatgacaccaatggtgctgtcattattaaacttggcactggtctaagcttcgacaacacaggcgccctaactgtgggaaacactggtgatgataaactgactctgtggacgaccccagacccatctccaaattgcagaattcactcagacaaagactgcaagtttactctcgtcctaactaagtgtggaagccaaatcctggcctctgtcgccgccctagcggtatcaggaaatctggcttcgataacaggcaccgttgccagcgttaccatctttcttagatttgatcagaatggagtgcttatggaaaactcctcactagacaagcagtactggaacttcagaaatggcaattcaactaatgctgccccctacaccaacgcagttgggttcatgccaaacctcgcagcgtaccccaaaacgcaaagccagactgctaaaaacaacattgtaagtcaggtttacttgaatggagacaaatccaaacccatgacccttaccatcaccctcaatggaactaatgaatccagtgaaactagtcaggtgagtcactactccatgtcatttacatgggcttgggaaagcgggcaatatgccactgaaacctttgccaccaactccttcaccttttcttacattgctgaacaataa

SEQ ID NO: 15 - DNA, 1632 bp, Chimpanzee Adenovirus- ChAd 19 Fiber; identical to SEQ ID NO: 13

SEQ ID NO: 16 - DNA, 2865 bp, Chimp0anzee Adenovirus- ChAd 20 Hexon
atggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaacccatgcgagtgggatgaggctgctactgcccttgacattgatttgaacgcagaagacgatgaagaaagcgacgaagctcaaggggaagcagatcagcagaaaactcatgtatttggccaggcgccctactccggacagaacattacaaaagaaggcatacagataggcatagatgctgccagtcaagcccagacacctgtatatgccgataaaacattccaaccagaacctcaagttggagaatcacagtggaatgagacagagattagttatggagcgggacgggtgcttaaaaaaaccactctcatgaaaccttgctatgggtcgtatgcaaggcctactaatgagaacggaggtcagggcatcctcttggaacaagatggaaagaaagaaagtcaagtggaaatgcaatttttctctactactcaggcagccgcgggtaattcagataatcctaccccaaaggttgttttgtacagcgaggatgttaacctggaaacaccagatacacacatttcatacatgcccaccaacaacgagacaaattcaagagagcttttgggacaacaggccatgcccaacaggcctaattacattggcttcagagacaactttatcggtctcatgtattacaacagcactggcaacatgggagtgcttgcaggtcaggcctctcagttgaacgcagtggtggacttgcaagacagaaacacagaactgtcataccagctcttgcttgattccatgggtgacagaaccagatacttttccatgtggaatcaggcagtggacagttatgacccagatgtcagaattattgaaaatcatggaactgaagacgagctccccaactattgtttccctctgggcggcgtaatcaatacggaaactttcacaaaagtaaaacctaaagctgcacaggacgctcagtgggaaaaagattcagaattttcagataaaaatgaaataagggtgggaaacaacttcgccatggaaattaacctcaatgccaatctgtggaggaactttttgtactccaacgtagccctctacttgcctgacaagcttaagtatactccatccaatgtgcaaatttccaacaatcccaactcctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctttccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctacccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaa

SEQ ID NO: 17 - DNA, 2823 bp, Chimpanzee Adenovirus- ChAd 4 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagcctggctcccaagggagcgcccaattccagccagtgggagcaaaaaaagactggcaataatgccaatggagatacggagaatgtcacttatggtgtagctgccatgggaggaattgacatcgataaaaatggccttcaaattggaaccgatgacaccaaagatgacgataatgaaatttatgcagacaaaacatatcagcctgagccgcaaataggagaggaaaactggcaagaaacatattcctactatggaggtagagctcttaaaaaagataccaaaatgaagccatgctatggctcatttgccagacctaccaatgtgaaaggaggacaggcaaaaataaaaacagatggagatgttaagtcatttgacatagacctagccttctttgatattcccaattctggcgcgggaaatggcacaaatgttaacgatgatccagatatggttatgtatacagaaaatgtaaatctggaaaccccagatactcatattgtgtacaaaccaggaacttcagatgacagctcaaaggtcaacttgtgtcagcaatccatgcctaacagacccaattatattggcttcagagacaattttattgggcttatgtactacaacagcactggcaatatgggtgtgctggctggtcaggcctctcaactgaatgccgtggtggacttgcaagacagaaacacagagctgtcctaccagctcttgcttgactctctgggtgacagaaccaggtatttcagtatgtggaatcaggcggtggacagttatgatcctgatgtgcgcattattgaaaaccatggtgtggaggatgaattgccaaactattgcttccccttggatggagcaggcaccaattcggtttaccaaggtgttaaaccaaaaactgacaatggcaacgatcagtgggaaacagattccacagtttcaagtcacaatcagatatgcaaaggcaatatctatgccatggagatcaacctccaggccaacctgtggagaagttttctctactcgaacgtggccctgtacctgcccgattcttacaagtacacgccggccaacatcaccctgcccaccaacaccaacacctacgattacatgaacgggagagtggtgcctccctcgctggtggacgcctacatcaacatcggggcgcgctggtcgctggaccccatggacaacgtgaatcccttcaaccaccaccgcaacgcgggcctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggaaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaa

SEQ ID NO: 18 - DNA, 2823 bp, Chimpanzee Adenovirus- ChAd 5 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagcctggctcccaagggagcgcccaattccagccagtgggagcaaaaaaagactggcaataatgccaatggagatacggagaatgtcacttatggtgtagctgccatgggaggaattgacatcgataaaaatggccttcaaattggaaccgatgacaccaaagatgacgataatgaaatttatgcagacaaaacatatcagcctgagccgcaaataggagaggaaaactggcaagaaacatattcctactatggaggtagagctcttaaaaaagataccaaaatgaagccatgctatggctcatttgccagacctaccaatgtgaaaggaggacaggcaaaaataaaaacagatggagatgttaagtcatttgacatagacctagccttctttgatattcccaattctggcgcgggaaatggcacaaatgttaacgatgatccagatatggttatgtatacagaaaatgtaaatctggaaaccccagatactcatattgtgtacaaaccaggaacttcagatgacagctcaaaggtcaacttgtgtcagcaatccatgcctaacagacccaattatattggcttcagagacaattttattgggcttatgtactacaacagcactggcaatatgggtgtgctggctggtcaggcctctcaactgaatgccgtggtggacttgcaagacagaaacacagagctgtcctaccagctcttgcttgactctctgggtgacagaaccaggtatttcagtatgtggaatcaggcggtggacagttatgatcctgatgtgcgcattattgaaaaccatggtgtggaggatgaattgccaaactattgcttccccttggatggagcaggcaccaattcggtttaccaaggtgttaaaccaaaaactgacaatggcaacgatcagtgggaaacagattccacagtttcaagtcacaatcagatatgcaaaggcaatatctatgccatggagatcaacctccaggccaacctgtggagaagttttctctactcgaacgtggccctgtacctgcccgattcttacaagtacacgccggccaacatcaccctgcccaccaacaccaacacctacgattacatgaacgggagagtggtgcctccctcgctggtggacgcctacatcaacatcggggcgcgctggtcgctggaccccatggacaacgtgaatcccttcaaccaccaccgcaacgcgggcctgcgctaccgctccatgctcctgggcaacgggcgctacgtgcccttccacatccaggtgccccagaaattttttgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaaagccaccacctaa

SEQ ID NO: 19 - DNA, 2823 bp, Chimpanzee Adenovirus- ChAd 7 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccttactccggcaccgcttacaacagcctggcccccaagggagcacccaattccagccagtgggagcaaaaaaagactggcaaaaatgccaatggagatacggagaatgtcacttatggtgtagctgccatgggaggaattgacatcgataaaaatggccttcaaattggaaccgatgacaccaaagatggcgataatgaaatttatgcagacaaaacatatcagcctgagccgcaaataggagaggaaaactggcaagaaacatattcctactatggaggtagagctcttaaaaaagataccaaaatgaagccatgctatggctcatttgctagacctaccaatgtgaaaggaggacaggcaaaaataaaaacagatggagatgttaagtcatttgacatagacctagccttctttgatattccaaattctggcgcgggaaatggcacaaatgttaacgatgatccagatatggttatgtatacagaaaatgtaaatctggaaaccccagatactcatattgtgtacaaaccaggaacttcagatgacagctccgaggtcaacttgtgtcagcaatccatgcctaacagacccaattatattggcttcagagacaattttattgggcttatgtactacaacagcactggcaatatgggtgtgctggctggtcaggcctctcaactgaatgccgtggtggacttgcaagacagaaacacagagctgtcctaccagctcttgcttgactctctgggtgacagaaccaggtatttcagtatgtggaatcaggcggtggacagttatgatcctgatgtgcgcattattgaaaaccatggtgtggaggatgaattgccaaactattgcttccccttggatggagcaggcaccaattcggtttaccaaggtgttaaaccaaaaactgacaatggcaacgatcagtgggaaacagattccacagtttcaagtcacaatcagatatgcaaaggcaatatctatgccatggagatcaatctccaggccaacctgtggagaagtttcctctactcgaacgtggccctgtacctgcccgattcttacaagtacacgccggccaacatcaccctgcccaccaacaccaacacctacgattacatgaacgggagagtggtgcctccctcgctggtggatgcctacatcaacatcggagcgcgctggtcgctggaccccatggacaacgtcaatcccttcaaccaccaccgcaatgcggggctgcgctaccgctccatgctcctgggcaacgggcgctacgtgcccttccacatccaggtgccccagaaatttttcgccatcaagagccttctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccatacttcgtctactcgggctccatcccctacctcgacggcaccttctacctcaaccacaccttcaagaaggtctccatcaccttcgattcctccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcgggcagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaa

SEQ ID NO: 20 - DNA, 2793 bp, Chimpanzee Adenovirus- ChAd 9 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcacccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcttacaacagcctggctcccaagggagcgcccaacacttgccagtggacatatactgataaccaaactgagaaaacagccacatatggaaatgcacccgtagagggcattaacattacaaaagatggcattcaacttggaactgacagcgatggtcaggcaatctatgcagacgaaacttatcagcccgaacctcaggtgggagatcctgaatggcatgataccacaggtacagaagaaaaatatggaggcagagcgcttaaacctgccaccgacatgaaaccttgctatggctcttttgccaagccaactaatgttaagggaggtcaggccaaaagcagaacaaaaactgatggaacaactgagcctgatattgacatggccttttttgatggcagaaatgcaacaacagctggtttgactccagaaattgttttgtatactgaaaatgtggatctggaaactccagatacccatattgtatacaaggcaggcacagatgacagcagctcttctatcaatttgggtcagcagtccatgcccaacagacccaactacattggcttcagagacaactttatcgggctcatgtactacaacagcactggcaatatgggtgtactggctggacaggcctcccagctgaatgctgtggtggacttgcaggacagaaacactgaactgtcctaccagctcttgcttgactctctgggtgacagaaccaggtatttcagtatgtggaatcaggcggtggacagttatgaccccgatgtgcgcattattgaaaatcacggtgtggaggatgaactccccaactattgcttccccctgaatgctgtgggtagaacaaatagttatcagggaattaaacccaatggaggcgatccagctacatgggccaaagatgaaagcgtcaatgattctaatgaattgggcaagggcaatcctttcgccatggagatcaacatccaggccaacctgtggcggaacttcctctacgcgaacgtggcgctgtacctgcccgactcctacaagtacacgccggccaacatcacgctgcccgccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctaggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaa

SEQ ID NO: 21 - DNA, 2793 bp, Chimpanzee Adenovirus- ChAd 10 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagcctggctcccaagggagcgcccaacacttgccagtggacatatactgataaccaaactgagaaaacagccacatatggaaatgcgcctgtgcaaggcattagtattacaaaagatggtattcaacttggaactgacactgatgatcagcccatttatgcagataaaacttatcaaccagagcctcaagtgggtgatgctgaatggcatgacatcactggtactgatgaaaaatatggaggcagagctctcaagcctgacaccaaaatgaagccctgctatggttcttttgccaagcctaccaataaagaaggaggtcaggcaaatgtgaaaaccgaaacaggcggtaccaaagaatatgacattgacatggcattcttcgataatcgaagtgcagctgcggctggcctggccccagaaattgttttgtatactgagaatgtggatctggaaactccagatactcatattgtatacaaggcaggcacagatgacagcagctcttctatcaatttgggtcagcagtccatgcccaacagacccaactacattggcttcagagacaactttatcggtctcatgtactacaacagcactggcaatatgggtgtactggctggtcaggcctcccagctgaatgctgtggtggacttgcaggacagaaacactgaactgtcctaccagctcttgcttgactctctgggtgacagaaccaggtattttagtatgtggaatcaggcggtggacagttatgaccccgatgtgcgcattattgaaaatcacggtgtggaggatgaactccctaattattgcttcccccttaatgctgtgggtagaactgatacttaccagggaattaaggccaatggtgctgatcaaaccacatggaccaaagatgatactgttaatgatgctaatgaattgggcaagggcaatcctttcgccatggagatcaacatccaggccaacctgtggcggaacttcctctacgcgaacgtggccctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagttcttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaatgccaccaacgtgcccatctccatcccctcgcgcaactgggccgccttccgcggatggtccttcacgcgcctcaagacccgcgagacgccctcgctaggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaa

SEQ ID NO: 22 - DNA, 2883 bp, Chimpanzee Adenovirus- ChAd 11 Hexon
atggcgaccccatcgatgatgccgcagtggtcgtacatgcacatctcgggccaggacgcctcggagtacctgagtcccgggctggtgcagttcgctcgcgccaccgagagctacttcagtctgagtaacaagtttaggaaccccacggtggcgcccacgcacgatgtgaccaccgaccggtcccagcgcctgacgctgcggttcatccccgtggaccgcgaggacaccgcgtactcgtacaaggcgcggttcaccctggccgtgggcgacaaccgcgtgctggacatggcctccacctactttgacatccgcggcgtgctggaccgcggccccaccttcaagccctactccggcaccgcytacaactccctggcccccaagggcgctcccaactcctgcgagtgggagcaagaggaaactcaggcagttgaagaagcagcagaagaggaggaagaagatgctgacggtcaagctgaggaagagcaagcagctaccaaaaagactcatgtatatgctcaggctcccctttccggcgaaaaaattagcaaagacggtctgcagataggaacggacgctacagcaaccgaacaaaaacctatttatgcagaccctacattccagcccgaaccccaaatcggggagtcccagtggaatgaggcagatgctacagtcgctggtggtagagtgctcaagaaaaccactcccatgaaaccatgctatggttcctatgcaagacccacgaatgctaatggaggtcagggtgtactagcggcaaatgcccaaggacagctagaatctcaggttgaaatgcaattcttttcaacttctgaaaacgcccgtaacgaggctaacaacattcagcccaaattggtgctgtatagcgaggatgtgcacatggagaccccggatacacacctctcttacaagcccacaaaaagcgatgacaattctaaagttatgctgggccaacaggccatgcccaacaggcctaattacattggcttcagagacaactttatcggtctcatgtactacaacagcactggcaacatgggagtgcttgcaggtcaggcctctcagttgaatgcagtggtggacttgcaagacagaaacacagaactgtcctaccagctcttgcttgattccatgggtgacagaaccagatatttctccatgtggaatcaggcagtggacagttatgacccagatgtcagaattattgaaaatcatggaactgaagacgagctccccaactattgtttccctctgggcggcataggggtaactgacacttaccaggctgttaagaccaacaatggcaataatgggggtcaggtgacttggacaaaagatgaaacttttgcagagcgcaatgagataggggtgggaaacaatttcgccatggagatcaacctcaatgccaacctgtggaggaacttcctgtactccaacgtggccctgtacctgccagacaagcttaagtacaacccctccaacgtggacatctctgacaaccccaacacctacgattacatgaacaagcgagtggtggccccggggctggtggactgctacatcaacctgggcgcgcgctggtcgctggactacatggacaacgtcaaccctttcaaccaccaccgcaacgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggcaacgatctcagggtggacggggccagcatcaagttcgagagcatctgcctctacgccaccttcttccccatggcccacaacaccgcctccacgctcgaggccatgctcaggaacgacaccaacgaccagtccttcaatgactacctctccgccgccaacatgctctaccccatccccgccaacgccaccaacgtccccatctccatcccctcgcgcaactgggcggccttccgcggctgggccttcacccgcctcaagaccaaggagaccccctccctgggctcgggattcgacccctactacacctactcgggatccattccctacctggacggcaccttctacctcaaccacactttcaagaaggtctcggtcaccttcgactcctcggtcagctggccgggcaacgaccgcctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctacccgctcataggcaagaccgcggtcgacagcatcacccagaaaaagttcctctgcgaccgcaccctctggcgcatccccttctccagcaacttcatgtccatgggtgcgctcacggacctgggccagaacctgctctatgccaactccgcccacgcgctcgacatgaccttcgaggtcgaccccatggacgagcccacccttctctatgttctgttcgaagtctttgacgtggtccgggtccaccagccgcaccgcggcgtcatcgagaccgtgtacctgcgcacgcccttctcggccggcaacgccaccacctaa

SEQ ID NO: 23 - DNA, 2835 bp, Chimpanzee Adenovirus- ChAd 16 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagctcccaattccagtcagtgggagcagacggagaacgggggcggacaggctacgactaaaacacacacctatggagttgccccaatgggtggaactaatattacagtcgacggactacaaattggaactgacgctacagctgatacggaaaaaccaatttatgctgataaaacattccaacctgagcctcagataggagaggaaaactggcaagaaactgaaagcttttatggcggtagggctcttaagaaagacacaaacatgaagccttgttatggctcatttgccagacctaccaatgaaaagggaggtcaagctaaacttaaagttggagctgatgggctgccgaccaaagaatttgacatagacctagcattctttgatactcctggtggcactgtgaccggaggtacagaggagtataaagcagatattgttatgtataccgaaaacacgtatctggaaactccagacacacatgtggtgtataaaccaggcaaggataacacaagttctaaaattaacctggtccagcagtctatgcccaacaggcccaactacattgggtttagggacaactttattgggctcatgtattacaacagcactggcaatatgggtgtgctggccggtcaggcttctcagttgaatgctgtggttgacttgcaagacagaaacactgaactgtcttaccagctcttgcttgactctttgggtgacagaaccaggtatttcagtatgtggaatcaggcggtggacagttatgatcctgatgtgcgcattattgaaaaccatggtgtggaagatgaacttcccaactattgcttccccctggatgggtctggcactaacgccgcttaccaaggtgtgaaagtaaaaaatggtcaagatggtgatgttgagagcgaatgggaaaaagatgatactgtcgcagctcgaaatcaattatgcaagggcaacatttttgccatggagatcaatctccaggccaacctgtggagaagttttctctactcgaacgtggccctgtacctgcccgattcttacaagtacacgccggccaacatcaccctgcccaccaacaccaacacctacgattacatgaacgggagagtggtgcctccctcgctggtggacgcctacatcaacatcggggcgcgctggtcgctggaccccatggacaacgtcaatcccttcaaccaccatcgcaacgcggggctgcgctaccgctccatgctcctgggcaacgggcgctacgtgcccttccacatccaggtgccccagaaatttttcgccattaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaa

SEQ ID NO: 24 - DNA, 2883 bp, Chimpanzee Adenovirus- ChAd 17 Hexon
  misc_feature (63)...(63): n = a, t, c, or g
atggcgaccccatcgatgatgccgcagtggtcgtacatgcacatctcgggccaggacgcctcngagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcacagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgagactaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagataactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagataaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctccattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctatccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaa

SEQ ID NO: 25 - DNA, 2877 bp, Chimpanzee Adenovirus- ChAd 19 Hexon
atggcgaccccatcgatgatgccgcagtggtcgtacatgcacatctcgggccaggacgcctcggagtacctgagccccgggctggtgcagttcgcccgcgccaccgagagctacttcagtctgagtaacaagtttaggaaccccacggtggcgcccacgcacgatgtgaccaccgaccggtcccagcgcctgacgctgcggttcatccccgtggaccgcgaggacaccgcgtactcgtacaaggcgcggttcaccctggccgtgggcgacaaccgcgtgctggacatggcctccacctactttgacatccgcggcgtgctggaccgcggccccaccttcaagccctactccggcaccgcctacaactccctggcccccaagggcgctcccaactcttgtgagtgggagcaattagaagaagcccaggccgctttggaagacgaagaattagaagatgaagacgaggaaccacaggatgaggcgcctgtgaaaaagacccatgtatacgctcaggctcccctttctggagaagaaattactaaagacggtttgcaaatagggtcagataacacagaagctcagtctaagcctatatatgcagaccctacattccagcccgaaccccaaatcggggagtcccagtggaacgaggcagatgctacagtcgctggtggtagagtgctcaagaaaaccactcccatgaaaccatgctatggttcctatgcaagacccacgaatgctaatggaggtcagggtgtgctggtggctgatgataagggggtccttcaatctaaagttgaattgcaatttttttcaaatactactactcttaatcagcgggagggtaatgatacaaaaccaaaagtagtgctgtatagcgaggatgtgcacatggaaacaccagacacccacatttcttacaagcccacaaaaagcgatgacaattctaaagttatgctgggccaacagtccatgcccaacaggcctaattacatcggcttcagagacaactttatcggtctcatgtactacaacagcactggcaacatgggagtgcttgcaggtcaggcctctcagttgaatgcagtggtggacttgcaagacagaaacacagaactgtcctaccagctcttgcttgattccatgggtgacagaaccagatatttctccatgtggaatcaggcagtggacagttatgacccggatgtcagaattattgaaaatcatggaaccgaagacgagctccccaactattgttttcctctgggtggcataggggtaactgacacttaccaggtcattaaaactaatggcaatggtcaagcagacccaacctgggaaaaagatacagagtttgcagaccgcaatgaaataggggtgggaaacaatttcgccatggagatcaacctcaatgccaacctgtggaggaacttcctgtactccaacgtggccctgtacctgccagacaagcttaagtacaacccctccaacgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaacgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctttgggcaacgatctcagggtggacggggccagcatcaagttcgagagcatctgcctctacgccaccttcttccccatggcccacaacaccgcctccacgctcgaggccatgctcaggaacgacaccaacgaccagtccttcaatgactacctctccgccgccaacatgctctaccccatccccgccaacgccaccaacgtccctatctccatcccctcgcgcaactgggcggccttccgcggctgggccttcacccgcctcaagaccaaggagacaccctccctgggctcgggattcgacccctactacacctactcgggatccattccctacctggacggcaccttctacctcaaccacactttcaagaaggtctcggtcaccttcgactcctcggtcagctggccgggcaacgaccgcctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccaaaccaagtacaaggactaccaggaggtgggcatcatccaccagcacaacaactcgggcttcgtgggctacctcgcccccaccatgcgcgagggacaggcctaccccgccaacttcccctacccgctcataggcaagaccgcggtcgacagcatcacccagaaaaagttcctctgcgaccgcaccctctggcgcatccccttctccagcaacttcatgtccatgggtgcgctcacggacctgggccagaacctgctctatgccaactccgcccacgcgctcgacatgaccttcgaggtcgaccccatggacgagcccacccttctctatgttctgttcgaagtctttgacgtggtccgggtccaccagccgcaccgcggcgtcatcgagaccgtgtacctgcgcacgcccttctcggccggcaacgccaccacctaa

SEQ ID NO: 26 - DNA, 49 bp, Artificial Sequence
  polA
aataaaagatctttattttcattagatctgtgtgttggttttttgtgtg

SEQ ID NO: 27 - DNA, 37 bp, Artificial Sequence
  Oligomer
atggaattcgtttaaaccatcatcaataatatacctc

SEQ ID NO: 28 - DNA, 23 bp, Artificial Sequence
  Oligomer
cgctggcactcaagagtggcctc

SEQ ID NO: 29 - DNA, 37 bp, Artificial Sequence
  Oligomer
atgaagcttgtttaaacccatcatcaataatatacct

SEQ ID NO: 30 - DNA, 26 bp, Artificial Sequence
  Oligomer
atctagacagcgtccatagcttaccg

SEQ ID NO: 31 - DNA, 44 bp, Artificial Sequence
  Oligomer
atgctacgtagcgatcgcgtgagtagtgtttgggggtgggtggg

SEQ ID NO: 32 - DNA, 33 bp, Artificial Sequence
  Oligomer
taggcgcgccgcttctcctcgttcaggctggcg

SEQ ID NO: 33 - DNA, 38 bp, Artificial Sequence
  Oligomer
gatctagttagtttaaacgaattcggatctgcgacgcg

SEQ ID NO: 34 - DNA, 37 bp, Artificial Sequence
  Oligomer
ttcgatcatgtttaaacgaaattaagaattcggatcc

SEQ ID NO: 35 - DNA, 33 bp, Artificial Sequence
  Oligomer
tattctgcgatcgctgaggtgggtgagtgggcg

SEQ ID NO: 36 - DNA, 31 bp, Artificial Sequence
  Oligomer
taggcgcgcccttaaacggcatttgtgggag

SEQ ID NO: 37 - DNA, 27 bp, Artificial Sequence
  Oligomer
cgtctagaagacccgagtcttaccagt

SEQ ID NO: 38 - DNA, 39 bp, Artificial Sequence
  Oligomer
cgggatccgtttaaaccatcatcaataatataccttatt

SEQ ID NO: 39 - DNA, 37 bp, Artificial Sequence
  Oligomer
atggaattcgtttaaaccatcatcaataatatacctt

SEQ ID NO: 40 - DNA, 45 bp, Artificial Sequence
  Oligomer
atgacgcgatcgctgatatcctataataataaaacgcagactttg

SEQ ID NO: 41 - DNA, 2880 bp, Chimpanzee Adenovirus- ChAd 3 Hexon
atggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggtcccactttcaagccctactctggcaccgcctacaactccctggcccccaagggcgctcccaactcctgcgagtgggagcaagaggaaactcaggcagttgaagaagcagcagaagaggaagaagaagatgctgacggtcaagctgaggaagagcaagcagctaccaaaaagactcatgtatatgctcaggctcccctttctggcgaaaaaattagtaaagatggtctgcaaataggaacggacgctacagctacagaacaaaaacctatttatgcagaccctacattccagcccgaaccccaaatcggggagtcccagtggaatgaggcagatgctacagtcgccggcggtagagtgctaaagaaatctactcccatgaaaccatgctatggttcctatgcaagacccacaaatgctaatggaggtcagggtgtactaacggcaaatgcccagggacagctagaatctcaggttgaaatgcaattcttttcaacttctgaaaacgcccgtaacgaggctaacaacattcagcccaaattggtgctgtatagtgaggatgtgcacatggagaccccggatacgcacctttcttacaagcccgcaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgttagaattattgaaaatcatggaactgaagacgagctccccaactattgtttccctctgggtggcataggggtaactgacacttaccaggctgttaaaaccaacaatggcaataacgggggccaggtgacttggacaaaagatgaaacttttgcagatcgcaatgaaataggggtgggaaacaatttcgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctttccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctctattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggaaggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctacccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacc

SEQ ID NO: 42 - DNA, 1683 bp, Chimpanzee Adenovirus- ChAd 3 Fiber
atgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagcccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtaagcacctcaggcgccctcaccgtagcagccgccgctcccctggcagtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcaccgttagcgccacaccaccaattaatgtaagcagtggaagtttaggcttagacatggaagaccctatgtatactcacgatggaaaactgggaataagaattgggggtccactaagagtagtagacagcttgcacacactcactgtagttaccggaaatggactaactgtagataacaatgccctccaaactagagttacgggcgccctaggttatgacacatcaggaaatctacaattgagagctgcaggaggtatgcgaattgatgcaaatggccaacttatccttaatgtggcatacccatttgatgctcagaacaatctcagccttagacttggtcagggacccctgtatataaacacagaccacaacctggatttgaattgcaacagaggtctaaccacaactaccaccaacaacacaaaaaaacttgagactaaaattagctcaggcttagactatgacaccaatggtgctgtcattattaaacttggcactggtctaagcttcgacaacacaggcgccctaactgtgggaaacactggtgatgataaactgactctgtggacgaccccagacccatctccaaattgcagaattcactcagacaaagactgcaagtttactctagtcctaactaagtgtggaagccaaatcctggcctctgtcgccgccctagcggtatcaggaaatctggcttcgataacaggcaccgttgccagcgttaccatctttctcagatttgatcagaatggagtgcttatggaaaactcctcgctagacaggcagtactggaacttcagaaatggcaactcaactaacgctgccccctacaccaatgcagttgggttcatgccaaacctcgcagcataccccaaaacgcaaagccagactgctaaaaacaacattgtaagtcaggtttacttgaatggagacaaatccaaacccatgacccttaccatcaccctcaatggaactaatgaatccagtgaaactagccaggtgagtcactactccatgtcatttacatgggcttgggaaagtgggcaatatgccactgaaacctttgccaccaactccttcaccttttcttacattgctgaacaa

SEQ ID NO: 43 - DNA, 2859 bp, Chimpanzee Adenovirus- ChAd 6 Hexon
atgtatgtccgccgaccagaaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccccagcttcaaaccctactccggcaccgcctacaacagcctggctcccaagggagcgcccaacacctcacagtggataaccaaagacaatggaactgataagacatacagttttggaaatgctccagtcagaggattggacattacagaagagggtctccaaataggacccgatgagtcagggggtgaaagcaagaaaatttttgcagacaaaacctatcagcctgaacctcagcttggagatgaggaatggcatgatactattggagctgaagacaagtatggaggcagagcgcttaaacctgccaccaacatgaaaccctgctatgggtctttcgccaagccaactaatgctaagggaggtcaggctaaaagcagaaccaaggacgatggcactactgagcctgatattgacatggccttctttgacgatcgcagtcagcaagctagtttcagtccagaacttgttttgtatactgagaatgtcgatctggacaccccggatacccacattatttacaaacctggcactgatgaaacaagttcttctttcaacttgggtcagcagtccatgcccaacagacccaactacatcggcttcagagacaactttatcggtctcatgtactacaacagtactggcaatatgggtgtactagctggacaggcctcccagctgaatgctgtggtggacttgcaggacagaaacactgaactgtcctaccagctcttgcttgactctctgggtgacagaaccaggtatttcagtatgtggaaccaggcggtggacagctacgaccccgatgtgcgcattattgaaaatcacggtgtggaggatgaactacccaactattgcttccctttgaatggtgtgggctttacagatacattccagggaattaaggttaaaactaccaataacggaacagcaaatgctacagagtgggaatctgatacctctgtcaataatgctaatgagattgccaagggcaatcctttcgccatggagatcaacatccaggccaacctgtggcggaacttcctctacgcgaacgtggcgctgtacctgcccgactcctacaagtacacgccggccaacatcacgctgcccgccaacaccaacacctacgattacatgaacggccgcgtggtagcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggttcagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggacagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggtaacgccaccacc

SEQ ID NO: 44 - DNA, 1335 bp, Chimpanzee Adenovirus- ChAd 6 Fiber
atgtccaaaaagcgcgcgcgggtggatgatgacttcgaccccgtgtacccctacgatgcagacaacgcaccgactgtgcccttcatcaaccctcccttcgtctcttcagatggattccaagaaaagcccctgggggtgttgtccctgcgactggccgatcccgtcaccaccaagaacggggctgtcaccctcaagctgggggagggggtggacctcgacgactcgggaaaactcatctccaaaaatgccaccaaggccactgcccctctcagtatttccaacaacaccatttcccttaacatggatacccctctttacaacaacaatggaaagctaggtatgaaggtaaccgcaccattaaagatattagacacagatctactaaaaacacttgttgttgcttatgggcagggattaggaacaaacaccaatggtgctcttgttgcccaactagcatacccacttgtttttaataccgctagcaaaattgcccttaatttaggcaatggaccattaaaagtggatgcaaatagactgaacattaattgcaaaagaggtatctatgtcactaccacaaaagatgcactggagattaatatcagttgggcaaatgctatgacatttataggaaatgccattggtgtcaatattgacacaaaaaaaggcctacagttcggcacttcaagcactgaaacagatgttaaaaatgcttttccactccaagtaaaacttggagctggtcttacatttgacagcacaggtgccattgttgcttggaacaaagaagatgacaaacttacactgtggaccacagccgatccatctccaaactgtcacatatattctgcaaaggatgctaagcttacactctgcttgacaaagtgtggtagtcagatactgggcactgtttctctcatagctgttgatactggtagcttaaatccaataacaggaaaagtaaccactgctcttgtttcacttaaattcgatgccaatggagttttgcaagccagttcaacactagataaagaatattggaatttcagaaaaggagatgtgacacctgctgacccctacactaatgctataggctttatgcccaaccttaatgcatacccaaaaaacacaaacgcagctgcaaaaagtcacattgttggaaaagtatacctacatggggatgaaagcaagccactagacttgataattacatttaatgaaaccagtgatgaatcctgtacttattgcattaactttcagtggcagtggggaactgaccaatataaagatgaaacacttgcagtcagttcattcaccttctcatacattgctaaagaa

SEQ ID NO: 45 - DNA, 22 bp, Artificial Sequence
  Primer
tgtcctaccarctcttgcttga

SEQ ID NO: 46 - DNA, 18 bp, Artificial Sequence
  Primer
gtggaarggcacgtagcg

SEQ ID NO: 47 - protein, 9 aa, HIV gag CD8 Epitope
  Primer
AMQMLKETI

SEQ ID NO: 48 - protein, 578 aa, Chimpanzee Adenovirus- ChAd 20 Fiber
MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLETSSPLTVSTSGALTVAAAAPLAVAGTSLTMQSEAPLTVQDAKLTLATKGPLTVSEGKLALQTSAPLTAADSSTLTVSATPPLSTSNGSLGIDMQAPIYTTNGKLGLNFGAPLHVVDSLNALTVVTGQGLTINGTALQTRVSGALNYDTSGNLELRAAGGMRVDANGQLILDVAYPFDAQNNLSLRLGQGPLFVNSAHNLDVNYNRGLYLFTSGNTKKLEVNIKTAKGLIYDDTAIAINAGDGLQFDSGSDTNPLKTKLGLGLDYDSSRAIIAKLGTGLSFDNTGAITVGNKNDDKLTLWTTPDPSPNCRIYSEKDAKFTLVLTKCGSQVLASVSVLSVKGSLAPISGTVTSAQIVLRFDENGVLLSNSSLDPQYWNYRKGDLTEGTAYTNAVGFMPNLTAYPKTQSQTAKSNIVSQVYLNGDKSKPMTLTITLNGTNETGDATVSTYSMSFSWNWNGSNYINETFQTNSFTFSYIAQE

SEQ ID NO: 49 - protein, 425 aa, Chimpanzee Adenovirus- ChAd 4 Fiber
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDHPFYTKDGKLSLQVSPPLNILRTSILNTLALGFGSGLGLRGSALAVQLVSPLTFDTDGNIKLTLDRGLHVTTGDAIESNISWAKGLKFEDGAIATNIGNGLEFGSSSTETGVDDAYPIQVKLGSGLSFDSTGAIMAGNKEDDKLTLWTTPDPSPNCQILAENDAKLTLCLTKCGSQILATVSVLVVGSGNLNPITGTVSSAQVFLRFDANGVLLTEHSTLKKYWGYRQGDSIDGTPYTNAVGFMPNLKAYPKSQSSTTKNNIVGQVYMNGDVSKPMLLTITLNGTDDSNSTYSMSFSYTWTNGSYVGATFGANSYTFSYIAQE

SEQ ID NO: 50 - protein, 444 aa, Chimpanzee Adenovirus- ChAd 5 Fiber
MSKKRVRVDDDFDPVYPYDADNAPTVPFINPPFVSSDGFQEKPLGVLSLRLADPVTTKNGEITLKLGDGVDLDDSGKLISNTATKAAAPLSFSNNTISLNMDTPLYNNNGKLGMKVTAPLKILDTDLLKTLVVAYGQGLGTNTNGALVAQLAYPLVFNTASKIALNLGNGPLKVDANRLNINCKRGIYVTTTKDALEINISWANAMTFIGNAIGVNIDTKKGLQFGTSSTETDVKNAFSLQVKLGAGLTFDSTGAIVAWNKEDDKLTLWTTADPSPNCHIYSAKDAKLTLCLTKCGSQILGTVSLLAVSGSLAPITGAVRTALVSLKFNANGALLDKSTLNKEYWNYRQGDLIPGTPYTHAVGFMPNKKAYPKNTTAASKSHIVGDVYLDGDADKPLSLIITFNETDDETCDYCINFQWKWGADQYKDKTLATSSFTFSYIAQE

SEQ ID NO: 51 - protein, 445 aa, Chimpanzee Adenovirus- ChAd 7 Fiber
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDTPFYNNNGKLGMKVTAPLKILDTDLLKTLVVAYGQGLGTNTTGALVAQLAAPLAFDSNSKIALNLGNGPLKVDANRLNINCNRGLYVTTTKDALETNISWANAMTFIGNAMGVNIDTQKGLQFGTTSTVADVKNAYPIQVKLGAGLTFDSTGAIVAWNKEDDKLTLWTTADPSPNCHIYSDKDAKLTLCLTKCGSQILGTVSLIAVDTGSLNPITGQVTTALVSLKFDANGVLQTSSTLDKEYWNFRKGDVTPAEPYTNAIGFMPNLKAYPKNTSGAAKSHIVGKVYLHGDTDKPLDLIITFNETSDESCTYCINFQWKWDSTKYTGETLATSSFTFSYIAQE

SEQ ID NO: 52 - protein, 425 aa, Chimpanzee Adenovirus- ChAd 9 Fiber
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDHPFYTKDGKLALQVSPPLNILRTSILNTLALGFGSGLGLRGSALAVQLVSPLTFDTDGNIKLTLDRGLHVTTGDAIESNISWAKGLKFEDGAIATNIGNGLEFGSSSTETGVDDAYPIQVKLGSGLSFDSTGAIMAGNKEDDKLTLWTTPDPSPNCQILAENDAKLTLCLTKCGSQILATVSVLVVGSGDLNPITGTVSSAQVFLRFDANGVLLTEHSTLKKYWGYRQGDSIDGTPYANAVGFMPNLKAYPKSQSSTTKNNIVGQVYMNGDVSKPMLLTITLNGTDDSNSTYSMSFSYTWTNGSYVGATFGANSYTFSYIAQE

SEQ ID NO: 53 - protein, 425 aa, Chimpanzee Adenovirus- ChAd 10 Fiber; identical to SEQ ID NO: 49

SEQ ID NO: 54 - protein, 578 aa, Chimpanzee Adenovirus- ChAd 11 Fiber
MKRTKTSDESFNPVYPYDTENGPPSVPFLTPPFVSPDGFQESPPGVLSLNLAEPLVTSHGMLALKMGSGLSLDDAGNLTSQDVTTTTPPLKKTKTNLSLETSAPLTVSTSGALTLAAAVPLAVAGTSLTMQSEAPLTVQDAKLTLATKGPLTVSEGKLALQTSAPLTAADSSTLTISATPPLSTSNGSLGIDMQAPIYTTNGKLGLNFGAPLHVVDSLNALTVVTGQGLTINGTALQTRVSGALNYDSSGNLELRAAGGMRVDANGKLILDVAYPFDAQNNLSLRLGQGPLFVNSAHNLDVNYNRGLYLFTSGNTKKLEVNIKTAKGLIYDDTAIAINPGDGLEFGSGSDTNPLKTKLGLGLEYDSSRAIIAKLGTGLSFDNTGAITVGNKNDDKLTLWTTPDPSPNCRIYSEKDAKFTLVLTKCGSQVLASVSVLSVKGSLAPISGTVTSAQIILRFDENGVLLSNSSLDPQYWNYRKGDLTEGTAYTNAVGFMPNLTAYPKTQSQTAKSNIVSQVYLNGDKSKPMILTITLNGTNETGDATVSTYSMSFSWNWNGSNYINETFQTNSFTFSYIAQE

SEQ ID NO: 55 - protein, 442 aa, Chimpansee Adenovirus- ChAd 16 Fiber
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDTPFYTKDGKLTMQVTAPLKLANTAILNTLAMAYGNGLGLSNNALTVQLQSPLTFNNSKVAINLGNGPLNVTSNRLSINCKRGVYVTTTGDAIETNISWSNAIKFIGNAMGVNIDTNKGLQFGTTSTVTDVTNAFPIQVKLGAGLAFDSTGAIVAWNKEDDSLTLWTTPDPSPNCKIASDKDAKLTLCLTKCGSQILGTVSLLAVSGSLAPITGAVSTALVSLKFDANGALLEKSTLNREYWNYRQGDLIPGTPYTHAVGFMPNKKAYPKNTTAASKSHIVGEVYLDGDADKPLSLIITFNETDDESCDYCMNFQWKWGADQYKDKTLATSSFTFSYIAQE

SEQ ID NO: 56 - protein, 543 aa, Chimpanzee Adenovirus- ChAd 17 Fiber
MKRTKTSDESFNPVYPYDTESGPPSVPFLTPPFVSPDGFQESPPGVLSLNLAEPLVTSHGMLALKMGSGLSLDDAGNLTSQDITSTTPPLKKTKTNLSLETSSPLTVSTSGALTVAAAAPLAVAGTSLTMQSEAPLAVQDAKLTLATKGPLTVSEGKLALQTSAPLTAADSSTLTVSSTPPISVSSGSLGLDMEDPMYTHDGKLGIRIGGPLRVVDSLHTLTVVTGNGLTVDNNALQTRVTGALGYDTSGNLQLRAAGGMRIDANGQLILDVAYPFDAQNNLSLRLGQGPLYVNTDHNLDLNCNRGLTTTTTNNTKKLETKISSGLDYDTNGAVIIKLGTGLSFDNTGALTVGNTGDDKLTLWTTPDPSPNCRIHSDKDCKFTLVLTKCGSQILASVAALAVSGNLASITGTVASVTIFLRFDQNGVLMENSSLDKQYWNFRNGNSTNAAPYTNAVGFMPNLAAYPKTQSQTAKNNIVSQVYLNGDKSKPMTLTITLNGTNESSETSQVSHYSMSFTWAWESGQYATETFATNSFTFSYIAEQ

SEQ ID NO: 57 - protein, 543 aa, Chimpanzee Adenovirus- ChAd 19 Fiber
MKRTKTSDKSFNPVYPYDTENGPPSVPFLTPPFVSPDGFQESPPGVLSLNLAEPLVTSHGMLALKMGSGLSLDDAGNLTSQDVTTTTPPLKKTKTNLSLETSAPLTVSTSGALTLAAAAPLAVAGTSLTMQSEAPLTVQDAKLTLATKGPLTVSEGKLALQTSAPLTAADSSTLTVSATPPISVSSGSLGLDMEDPMYTHDGKLGIRIGGPLRVVDSLHTLTVVTGNGIAVDNNALQTRVTGALGYDTSGNLQLRAAGGMRIDANGQLILDVAYPFDAQNNLSLRLGQGPLYVNTDHNLDLNCNRGLTTTTTNNTKKLETKIGSGLDYDTNGAVIIKLGTGVSFDSTGALSVGNTGDDKLTLWTTPDPSPNCRIHSDKDCKFTLVLTKCGSQILASVAALAVSGNLASITGTVSSVTIFLRFDQNGVLMENSSLDKQYWNFRNGNSTNATPYTNAVGFMPNLAAYPKTQSQTAKNNIVSQVYLNGDKSKPMTLTITLNGTNESSETSQVSHYSMSFTWAWESGQYATETFATNSFTFSYIAEQ

SEQ ID NO: 58 - DNA, 963 bp, Chimapnzee Adenovirus- ChAd 8 Fiber
atgaccaaacgagttcgactaagcagctccttcaatccggtctacccctatgaagatgaaagcagctcccaacacccctttataaaccctggtttcatttcctcaaatggatttacacaaagcccagatggggttcttacacttaaatgcttatcgccgctcaccaccacaggcggctcccttcaacttaaagttggaggaggattatcagtggatgacactgacggttcattagaagaaaacataagcattacagcaccacttaataaaacaagtcactcaataggtttatccataggagatgggttggaaacaaaaaacaaccaactatgtgctaagctgggagacggtcttacatttaatacaggcagcatatgcatagatactgacattaatacattatggacaggagcaacaccagacgctaattgcttagtccttggaactgaatctaatgattgtaaacttacactggcacttgtaaagtcaggagccttagtaaatgcttacgtagcacttgttggagcctcagacgccgttaatgatttaaccacagaaacaagtgctcaaataattgcagacatatattttgatgcgcaaggaaaacttcttcctgatttatcagcactcaaaacagagctaaaacacaaatctggacaaggcacttcgacagcagatcccaataactgtaaaagctttatgccaagtctaaatgcatatccactgcgccccaatggaggcaacggaaactatatttatggaaccacctactacagggccagagatgaaaccctttatgaacttaaaacctctgtaatgcttaactacaaaattaccagtggactatgtgcatatgccatgcattttcagtggtcttggaatagtgggactaaaccagaagacactcccgccactttcattgcctccccctttgtcttttcctacattagagaagatgactga

SEQ ID NO: 59 - protein, 320 aa, Chimpanzee Adenovirus- ChAd 8 Fiber
MTKRVRLSSSFNPVYPYEDESSSQHPFINPGFISSNGFTQSPDGVLTLKCLSPLTTTGGSLQLKVGGGLSVDDTDGSLEENISITAPLNKTSHSIGLSIGDGLETKNNQLCAKLGDGLTFNTGSICIDTDINTLWTGATPDANCLVLGTESNDCKLTLALVKSGALVNAYVALVGASDAVNDLTTETSAQIIADIYFDAQGKLLPDLSALKTELKHKSGQGTSTADPNNCKSFMPSLNAYPLRPNGGNGNYIYGTTYYRARDETLYELKTSVMLNYKITSGLCAYAMHFQWSWNSGTKPEDTPATFIASPFVFSYIREDD

SEQ ID NO: 60 - DNA, 1062 bp, Chimpanzee Adenovirus- ChAd 22 Fiber
atggccaaacgagctcggctaagcagctccttcaatccggtctacccctatgaagatgaaagcagctcacaacacccctttataaaccctggtttcatttcctcaaatggttttgcacaaagcccagatggagttctaactcttaaatgtgttaatccgctcactaccgccagcggacccctccaacttaaagttggaagcagtcttacagtagataatatcgatgggtctttggaggaaaatataactgccgcagcgccactcactaaaactaaccactccataggtttatcaataggatctggcttgcaaacaaaggatgataaactttgtttatcgctgggagatgggttggtaacaaaggatgataaactatgtttatcgctgggagatgggttaataacaaaagatgatacactatgtgccaaactaggacatggccttgtgtttgactcttccaatgctatcaccatagaaaacaacaccttgtggacaggtgcaaaaccaagcgccaactgtgtaattaaagagggagaagattccccagactgtaagctcactttagttctagtgaagaatggaggactgataaatggatacataacattaatgggagcctcagaatatactaacaccttgtttaaaaacaaacaagttacaatcgatgtaaacctcgcatttgataatactggccaaattatcacttacctatcatcccttaaaagtaacctgaactttaaagacaaccaaaacatggctactggaaccataaccagtgccaaaggcttcatgcccagcaccaccgcctatccatttataacatacgccactcagtccctaaatgaagattacatttatggagagtgttactacaaatctaccaatggaactctctttccactaaaagttactgtcacactaaacagacgtatgtcagcttctggaatggcctatgctatgaatttttcatggtctctaaatgcagaggaagccccggaaactaccgaagtcactctcattacctcccccttctttttttcttatatcagagaagatgactga

SEQ ID NO: 61 - protein, 353 aa, Chimpanzee Adenovirus- ChAd 22 Fiber
MAKRARLSSSFNPVYPYEDESSSQHPFINPGFISSNGFAQSPDGVLTLKCVNPLTTASGPLQLKVGSSLTVDNIDGSLEENITAAAPLTKTNHSIGLSIGSGLQTKDDKLCLSLGDGLVTKDDKLCLSLGDGLITKDDTLCAKLGHGLVFDSSNAITIENNTLWTGAKPSANCVIKEGEDSPDCKLTLVLVKNGGLINGYITLMGASEYTNTLFKNKQVTIDVNLAFDNTGQIITYLSSLKSNLNFKDNQNMATGTITSAKGFMPSTTAYPFITYATQSLNEDYIYGECYYKSTNGTLFPLKVTVTLNRRMSASGMAYAMNFSWSLNAEEAPETTEVTLITSPFFFSYIREDD

SEQ ID NO: 62 - DNA, 1686 bp, Chimpanzee Adenovirus- ChAd 24 Fiber
atgtcagattcttgctcctgtccttccgcacccactatcttcatgttgttgcagatgaagcgcaccaaaacgtctgacgagagcttcaaccccgtgtacccctatgacacggaaaacggtcctccctccgtccctttcctcacccctcccttcgtgtctcccgatggattccaagagagcccccccggggtcctgtctctgaacctggccgagcccctggtcacttcccacggcatgctcgccctgaaaatgggaagtggcctctccctggacgacgccggcaacctcacctctcaagatgtcaccaccactacccctcccctgaaaaaaaccaagaccaacctcagcctagaaacctcagcccccctgactgtgagcacctcaggcgccctcaccctagcggccgccgctcccctggcggtggccggcacctccctcaccatgcaatcagaggcccccctgacagtacaggatgcaaaactcaccctggccaccaagggccccctgaccgtgtctgaaggcaaactggccttgcagacctcggccccactgacggccgctgacagcagcaccctcaccgttagcgccacaccacccatcaatgtaagcagtggaagtttgggcttagacatggaaaatcccatgtatactcatgacggaaaactgggaataagaattgggggcccactgagagtagtagacagcctgcacacactgactgtagttaccggaaatggaatagctgtagataacaatgccctccaaactagagttacgggcgccctgggttatgacacatcaggaaacctacaactgagagccgcggggggtatgcgaattgatgcaaatggccaacttatccttgatgtggcatacccatttgatgctcaaaacaatctcagccttagacttggtcagggacccctgtatgtaaacacagaccacaacctagatttgaattgcaacagaggtctgaccacaactaccaccaacaacacaaaaaaacttgaaactaaaattggctcaggcttagactatgataccaatggtgctgtcattattaaacttggcactggtgtcagctttgacagcacaggcgccctaagtgtgggaaacactggcgatgataaactgactctgtggacaaccccagacccatctccaaattgcagaattcactcagacaaagactgcaagtttactctagtcctaactaagtgtggaagtcaaatcctggcttctgtcgccgccctagcggtgtcaggaaatctggcttcaataacaggcaccgtttccagcgttaccatctttctcagatttgatcagaatggagtgcttatggaaaactcctcgctagacaagcagtactggaactttagaaatggtaattcaaccaatgccaccccctacaccaatgcagttggtttcatgccaaacctcgcagcataccccaagacacagagtcagactgctaaaaacaacattgtaagtcaggtttacttgaatggggacaaatccaaacccatgatccttaccattaccctcaatggaactaatgaatccagtgaaactagccaggtgagtcactactccatgtcatttacgtgggcttgggagagtgggcaatatgccaccgaaacctttgccaccaattcctttaccttctcttacattgctgaacaataa

SEQ ID NO: 63 - protein, 543 aa, Chimpanzee Adenovirus- ChAd 24 Fiber
MKRTKTSDESFNPVYPYDTENGPPSVPFLTPPFVSPDGFQESPPGVLSLNLAEPLVTSHGMLALKMGSGLSLDDAGNLTSQDVTTTTPPLKKTKTNLSLETSAPLTVSTSGALTLAAAAPLAVAGTSLTMQSEAPLTVQDAKLTLATKGPLTVSEGKLALQTSAPLTAADSSTLTVSATPPINVSSGSLGLDMENPMYTHDGKLGIRIGGPLRVVDSLHTLTVVTGNGIAVDNNALQTRVTGALGYDTSGNLQLRAAGGMRIDANGQLILDVAYPFDAQNNLSLRLGQGPLYVNTDHNLDLNCNRGLTTTTTNNTKKLETKIGSGLDYDTNGAVIIKLGTGVSFDSTGALSVGNTGDDKLTLWTTPDPSPNCRIHSDKDCKFTLVLTKCGSQILASVAALAVSGNLASITGTVSSVTIFLRFDQNGVLMENSSLDKQYWNFRNGNSTNATPYTNAVGFMPNLAAYPKTQSQTAKNNIVSQVYLNGDKSKPMILTITLNGTNESSETSQVSHYSMSFTWAWESGQYATETFATNSFTFSYIAEQ

SEQ ID NO: 64 - DNA, 1335 bp, Chimpanzee Adenovirus- ChAd 26 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgtctggccgatcccgtcaccaccaagaacggggaaatcaccctcaagctgggagatggggtggacctcgacgactcgggaaaactcatctccaacacggccaccaaggccgccgcccctctcagtttttccaacaacaccatttcccttaacatggatacccctctttacaacaacaatggaaagctaggtatgaaggtaaccgcaccattaaagatattagacacagatctactaaaaacacttgttgttgcttatgggcagggattaggaacaaacaccaatggtgctcttgttgcccaactagcatacccacttgtttttaataccgctagcaaaattgcccttaatttaggcaatggaccattaaaagtggatgcaaatagactgaacattaattgcaaaagaggtatctatgtcactaccacaaaagatgcactggagattaatatcagttgggcaaatgctatgacatttataggaaatgccattggtgtcaatattgacacaaaaaaaggcctacagttcggcacttcaagcactgaaacagatgttaaaaatgcttttccactccaagtaaaacttggagctggtcttacatttgacagcacaggtgccattgttgcttggaacaaagaagatgacaaacttacactgtggaccacagccgatccatctccaaactgtcacatatattctgcaaaggatgctaagcttacactctgcttgacaaagtgtggtagtcaaatcctaggcactgtctccctattagcagtcagtggcagcttggctcctatcacaggggctgttagaactgcacttgtatcactcaaattcaatgctaatggagcccttttggacaaatcaactctgaacaaagaatactggaactacagacaaggagatctaattccaggtacaccatatacacatgctgtgggtttcatgcctaacaaaaaagcctaccctaaaaacacaactgcagcttccaagagccacattgtgggtgatgtgtatttagatggagatgcagataaacctttatctcttatcatcactttcaatgaaactgatgatgaaacctgtgattactgcatcaactttcaatggaaatggggagctgatcaatataaggataagacactcgcaaccagttcattcaccttctcatacatcgcccaagaataa

SEQ ID NO: 65 - protein, 444 aa, Chimpanzee Adenovirus- ChAd 26 Fiber
MSKKRVRVDDDFDPVYPYDADNAPTVPFINPPFVSSDGFQEKPLGVLSLRLADPVTTKNGEITLKLGDGVDLDDSGKLISNTATKAAAPLSFSNNTISLNMDTPLYNNNGKLGMKVTAPLKILDTDLLKTLVVAYGQGLGTNTNGALVAQLAYPLVFNTASKIALNLGNGPLKVDANRLNINCKRGIYVTTTKDALEINISWANAMTFIGNAIGVNIDTKKGLQFGTSSTETDVKNAFPLQVKLGAGLTFDSTGAIVAWNKEDDKLTLWTTADPSPNCHIYSAKDAKLTLCLTKCGSQILGTVSLLAVSGSLAPITGAVRTALVSLKFNANGALLDKSTLNKEYWNYRQGDLIPGTPYTHAVGFMPNKKAYPKNTTAASKSHIVGDVYLDGDADKPLSLIITFNETDDETCDYCINFQWKWGADQYKDKTLATSSFTFSYIAQE

SEQ ID NO: 66 - DNA, 1062 bp, Chimpanzee Adenovirus- ChAd 30 Fiber
atggccaaacgagctcggctaagcagctccttcaatccggtctacccctatgaagatgaaagcagctcacaacacccctttataaaccctggtttcatttcctcaaatggttttgcacaaagcccagatggagttctaactcttaaatgtgttaatccgctcactaccgccagcggacccctccaacttaaagttggaagcagtcttacagtagatactatcgatgggtctttggaggaaaatataactgccgcagcgccactcactaaaactaaccactccataggtttatcaataggatctggcttgcaaacaaaggatgataaactttgtttatcgctgggagatgggttggtaacaaaggatgataaactatgtttatcgctgggagatgggttaataacaaaagatgatacactatgtgccaaactaggacatggccttgtgtttgactcttccaatgctatcaccatagaaaacaacaccttgtggacaggtgcaaaaccaagcgccaactgtgtaattaaagagggagaagattccccagactgtaagctcactttagttctagtgaagaatggaggactgataaatggatacataacattaatgggagcctcagaatatactaacaccttgtttaaaaacaaacaagttacaatcgatgtaaacctcgcatttgataatactggccaaattatcacttacctatcatcccttaaaagtaacctgaactttaaagacaaccaaaacatggctactggaaccataaccagtgccaaaggcttcatgcccagcaccaccgcctatccatttataacatacgccactcagtccctaaatgaagattacatttatggagagtgttactacaaatctaccaatggaactctctttccactaaaagttactgtcacactaaacagacgtatgtcagcttctggaatggcctatgctatgaatttttcatggtctctaaatgcagaggaagccccggaaactaccgaagtcactctcattacctcccccttctttttttcttatatcagagaagatgactga

SEQ ID NO: 67 - protein, 353 aa, Chimpanzee Adenovirus- ChAd 30 Fiber
MAKRARLSSSFNPVYPYEDESSSQHPFINPGFISSNGFAQSPDGVLTLKCVNPLTTASGPLQLKVGSSLTVDTIDGSLEENITAAAPLTKTNHSIGLSIGSGLQTKDDKLCLSLGDGLVTKDDKLCLSLGDGLITKDDTLCAKLGHGLVFDSSNAITIENNTLWTGAKPSANCVIKEGEDSPDCKLTLVLVKNGGLINGYITLMGASEYTNTLFKNKQVTIDVNLAFDNTGQIITYLSSLKSNLNFKDNQNMATGTITSAKGFMPSTTAYPFITYATQSLNEDYIYGECYYKSTNGTLFPLKVTVTLNRRMSASGMAYAMNFSWSLNAEEAPETTEVTLITSPFFFSYIREDD

SEQ ID NO: 68 - DNA, 1791 bp, Chimpanzee Adenovirus- ChAd 31 Fiber
atgtcagattcttgctcctgtccctccgcacccactatcttcatgttgttgcagatgaagcgcaccaaaacgtctgacgagagcttcaaccccgtgtacccctatgacacggaaagcggccctccctccgtccctttcctcacccctcccttcgtgtctcccgatggattccaagaaagtccccccggggtcctgtctctgaacctggccgagcccctggtcacttcccacggcatgctcgccctgaaaatgggaagtggcctctccctggacgacgctggcaacctcacctctcaagatatcaccaccgctagccctcccctcaaaaaaaccaagaccaacctcagcctagaaacctcatcccccctaactgtgagcacctcaggcgccctcaccgtagcagccgccgctcccctggcggtggccggcacctccctcaccatgcaatcagaggcccccctgacagtacaggatgcaaaactcaccctggccaccaaaggccccctgaccgtgtctgaaggcaaactggccttgcaaacatcggccccgctgacggccgctgacagcagcaccctcacagtcagtgccacaccaccccttagcacaagcaatggcagcttgggtattgacatgcaagcccccatttacaccaccaatggaaaactaggacttaactttggcgctcccctgcatgtggtagacagcctaaatgcactgactgtagttactggccaaggtcttacgataaacggaacagccctacaaactagagtctcaggtgccctcaactatgacacatcaggaaacctagaattgagagctgcagggggtatgcgagttgatgcaaatggtcaacttatccttgatgtagcttacccatttgatgcacaaaacaatctcagccttaggcttggacagggacccctgtttgttaactctgcccacaacttggatgttaactacaacagaggcctctacctgttcacatctggaaataccaaaaagctagaagttaatatcaaaacagccaagggtctcatttatgatgacactgctatagcaatcaatgcgggtgatgggctacagtttgactcaggctcagatacaaatccattaaaaactaaacttggattaggactggattatgactccagcagagccataattgctaaactgggaactggcctaagctttgacaacacaggtgccatcacagtaggcaacaaaaatgatgacaagcttaccttgtggaccacaccagacccatcccctaactgtagaatctattcagagaaagatgctaaattcacacttgttttgactaaatgcggcagtcaggtgttggccagcgtttctgttttatctgtaaaaggtagccttgcgcccatcagtggcacagtaactagtgctcagattgtcctcagatttgatgaaaatggagttctactaagcaattcttcccttgaccctcaatactggaactacagaaaaggtgaccttacagagggcactgcatataccaacgcagtgggatttatgcccaacctcacagcatacccaaaaacacagagccaaactgctaaaagcaacattgtaagtcaggtttacttgaatggggacaaatccaaacccatgaccctcaccattaccctcaatggaactaatgaaacaggagatgccacagtaagcacttactccatgtcattctcatggaactggaatggaagtaattacattaatgaaacgttccaaaccaactccttcaccttctcctacatcgcccaagaataa

SEQ ID NO: 69 - protein, 578 aa, Chimpanzee Adenovirus- ChAd 31 Fiber; identical to SEQ ID NO: 48

SEQ ID NO: 70 - DNA, 978 bp, Chimpanzee Adenovirus- ChAd 37 Fiber
atggccaaacgggctcgtctaagcagctccttcaacccggtgtacccctatgaagacgagagcagctcacaacacccatttataaaccccggcttcatttcccctgatggctttacacaaagcccagacggagttctaacactgaaatgtgtttcccctcttactaccaccagtggcgctctagacattaaagtgggaagagggcttaaagtagatagcactgatggttccctggaagaaaatatagacattacagctcccctcactaaatttaaccactcagtaggattagcatttggcgacggtctagaaacaaaagaaaacaagctttatgtaaaacttggagatggacttaaatttagctctggcagtatatacattgaccatgatgttaacactttatggacaggagtcaatccaagtgctaactgtataattacagacaatggagaaaccaatgacagcaagcttaccctaatacttgttaagtcaggtggattaataaatgcttatgtctcattaatgggtgactcagacacagtcaataaattaaccacagaaaaaagtgctcaaattaccgttgacatatactttgataatcaaggaaaagttcttactgaactatcggcccttaaaacagatcttaaacataaatttggtcaaaacatggcttctagcgaagtatcaaactgcaaaggctttatgccaagcttaaatgcatacccattcagaaatccaactaaacctaccaaaggaagagaagactacatttatggaataacttactatcaagccacagatggtaatctctatgagctaaaaactactattactctaaaccacagtgtcattagttctctatgtgcatatgcaatgcacatttcatggtcatgggacaccgtaacagagccagagacaacacccactactcttattacctcccccttctccttttcctatatcagagaagatgactga

SEQ ID NO: 71 - protein, 325 aa, Chimpanzee Adenovirus- ChAd 37 Fiber
MAKRARLSSSFNPVYPYEDESSSQHPFINPGFISPDGFTQSPDGVLTLKCVSPLTTTSGALDIKVGRGLKVDSTDGSLEENIDITAPLTKFNHSVGLAFGDGLETKENKLYVKLGDGLKFSSGSIYIDHDVNTLWTGVNPSANCIITDNGETNDSKLTLILVKSGGLINAYVSLMGDSDTVNKLTTEKSAQITVDIYFDNQGKVLTELSALKTDLKHKFGQNMASSEVSNCKGFMPSLNAYPFRNPTKPTKGREDYIYGITYYQATDGNLYELKTTITLNHSVISSLCAYAMHISWSWDTVTEPETTPTTLITSPFSFSYIREDD

SEQ ID NO: 72 - DNA, 1332 bp, Chimpanzee Adenovirus- ChAd 38 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctttttataccaaagatggaaaattatccttacaagtttctccaccattaaacatattaaaatcaaccattctgaacacattagctgtagcttatggatcaggtttaggactcagtggtggcactgctcttgcagtacagttggcctctccactcacctttgatgaaaaaggaaatattaaaattaacctagccagtggtccattaacagttgatgcaagtcgacttagtatcaactgcaaaagaggggtcactgtcactaccgcaggagatgcaattaaaagcaacataagctggcctaaaggtataagatttgaaggtgatgccatagctgcaaacattggcagaggattggaatttggaaccactagtacagagactgatgtcacagatgcatacccaattcaagttaaattgggtactggtctcacctttgacagtacaggcgccattgttgcatggaacaaagaggatgataaacttacattatggaccacagccgacccctcgccaaattgcaaaatatactctgaaaaagatgctaaactcacactttgcttgacaaaatgtggaagccaaattctgggcactgtgactgtattggcagtgaataatggaagtctcaacccaatcacaaacacagtaagcactgcacttgtctccctcaagtttgatgcaagtggagttttgctaagcagctccacattagacaaagaatattggaacttccgaaagggagatgttacacctgctgaaccctatactaatgctataggttttatgcctaacataaaggcctatcctaaaaacacatctgcagcttcaaaaagccatattgtcagtcaagtttatctcaatggggatgaaaccaaacctctgatgctgattattacttttaatgaaactgaggatgcaacttgcacctatagtatcacttttcaatggaaatgggatagtactaagtacacaggtaaaacacttgctaccagctccttcaccttctcctacattgctcaagaatga

SEQ ID NO: 73 - protein, 443 aa, Chimpanzee Adenovirus- ChAd 38 Fiber
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDTPFYTKDGKLSLQVSPPLNILKSTILNTLAVAYGSGLGLSGGTALAVQLASPLTFDEKGNIKINLASGPLTVDASRLSINCKRGVTVTTAGDAIKSNISWPKGIRFEGDAIAANIGRGLEFGTTSTETDVTDAYPIQVKLGTGLTFDSTGAIVAWNKEDDKLTLWTTADPSPNCKIYSEKDAKLTLCLTKCGSQILGTVTVLAVNNGSLNPITNTVSTALVSLKFDASGVLLSSSTLDKEYWNFRKGDVTPAEPYTNAIGFMPNIKAYPKNTSAASKSHIVSQVYLNGDETKPLMLIITFNETEDATCTYSITFQWKWDSTKYTGKTLATSSFTFSYIAQE

SEQ ID NO: 74 - DNA, 1332 bp, Chimpanzee Adenovirus- ChAd 44 Fiber
atgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggctgaccccgtcaccaccaagaacggggaaatcaccctcaagctgggagagggggtggacctcgactcgtcgggaaaactcatctccaacacggccaccaaggccgccgcccctctcagtatttcaaacaacaccatttcccttaaaactgctgcccctttctacaacaacaatggaactttaagcctcaatgtctccacaccattagcagtatttcccacatttaacactttaggcataagtcttggaaacggtcttcagacttcaaataagttgttgactgtacaactaactcatcctcttacattcagctcaaatagcatcacagtaaaaacagacaaagggctatatattaactccagtggaaacagaggacttgaggctaatataagcctaaaaagaggactagtttttgacggtaatgctattgcaacatatattggaaatggcttagactatggatcttatgatagtgatggaaaaacaagacccgtaattaccaaaattggagcaggattaaattttgatgctaacaaagcaatagctgtcaaactaggcacaggtttaagttttgactccgctggtgccttgacagctggaaacaaacaggatgacaagctaacactttggactacccctgacccaagccctaattgtcaattactttcagacagagatgccaaatttactctctgtcttacaaaatgcggtagtcaaatactaggcactgtggcagtggcggctgttactgtaggatcagcactaaatccaattaatgacacagtcaaaagcgccatagttttccttagatttgattccgatggtgtactcatgtcaaactcatcaatggtaggtgattactggaactttagggagggacagaccactcaaagtgtagcctatacaaatgctgtgggattcatgccaaatataggtgcatatccaaaaacccaaagtaaaacacctaaaaatagcatagtcagtcaggtatatttaactggagaaactactatgccaatgacactaaccataactttcaatggcactgatgaaaaagacacaaccccagttagcacctactctatgacttttacatggcagtggactggagactataaggacaaaaatattacctttgctaccaactcattctctttttcctacatcgcccaggaataa

SEQ ID NO: 75 - protein, 443 aa, Chimpanzee Adenovirus- ChAd 44 Fiber
MSKKRVRVDDDFDPVYPYDADNAPTVPFINPPFVSSDGFQEKPLGVLSLRLADPVTTKNGEITLKLGEGVDLDSSGKLISNTATKAAAPLSISNNTISLKTAAPFYNNNGTLSLNVSTPLAVFPTFNTLGISLGNGLQTSNKLLTVQLTHPLTFSSNSITVKTDKGLYINSSGNRGLEANISLKRGLVFDGNAIATYIGNGLDYGSYDSDGKTRPVITKIGAGLNFDANKAIAVKLGTGLSFDSAGALTAGNKQDDKLTLWTTPDPSPNCQLLSDRDAKFTLCLTKCGSQILGTVAVAAVTVGSALNPINDTVKSAIVFLRFDSDGVLMSNSSMVGDYWNFREGQTTQSVAYTNAVGFMPNIGAYPKTQSKTPKNSIVSQVYLTGETTMPMTLTITFNGTDEKDTTPVSTYSMTFTWQWTGDYKDKNITFATNSFSFSYIAQE

SEQ ID NO: 76 - DNA, 1278 bp, Chimpanzee Adenovirus- ChAd 63 Fiber; identical to SEQ ID NO: 11

SEQ ID NO: 77 - protein, 425 aa, Chimpanzee Adenovirus- ChAd 63 Fiber; identical to SEQ ID NO: 49

SEQ ID NO: 78 - DNA, 1338 bp, Chimpanzee Adenovirus- ChAd 82 Fiber
atgtccaaaaagcgcgcgcgggtggatgatgacttcgaccccgtgtacccctacgatgcagacaacgcaccgactgtgcccttcatcaaccctcccttcgtctcttcagatggattccaagaaaagcccctgggggtgttgtccctgcgactggccgatcccgtcaccaccaagaacggggctgtcaccctcaagctgggggagggggtggacctcgacgactcgggaaaactcatctccaaaaatgccaccaaggccactgcccctctcagtatttccaacaacaccatttcccttaacatggatacccctctttacaacaacaatggaaagctaggtatgaaggtaaccgcaccattaaagatattagacacagatctactaaaaacacttgttgttgcttatgggcagggattaggaacaaacaccaatggtgctcttgttgcccaactagcatacccacttgtttttaataccgctagcaaaattgcccttaatttaggcaatggaccattaaaagtggatgcaaatagactgaacattaattgcaaaagaggtatctatgtcactaccacaaaagatgcactggagattaatatcagttgggcaaatgctatgacatttataggaaatgccattggtgtcaatattgacacaaaaaaaggcctacagttcggcacttcaagcactgaaacagatgttaaaaatgcttttccactccaagtaaaacttggagctggtcttacatttgacagcacaggtgccattgttgcttggaacaaagaagatgacaaacttacactgtggaccacagccgatccatctccaaactgtcacatatattctgcaaaggatgctaagcttacactctgcttgacaaagtgtggtagtcagatactgggcactgtttctctcatagctgttgatactggtagcttaaatccaataacaggaaaagtaaccactgctcttgtttcacttaaattcgatgccaatggagttttgcaagccagttcaacactagataaagaatattggaatttcagaaaaggagatgtgacacctgctgacccctacactaatgctataggctttatgcccaaccttaatgcatacccaaaaaacacaaacgcagctgcaaaaagtcacattgttggaaaagtatacctacatggggatgtaagcaagccactagacttgataattacatttaatgaaaccagtgatgaatcctgtacttattgcattaactttcagtggcggtggggaactgaccaatataaagatgaaacacttgcagtcagttcattcaccttctcatacattgctaaagaataa

SEQ ID NO: 79 - protein, 445 aa, Chimpanzee Adenovirus- ChAd 82 Fiber
MSKKRARVDDDFDPVYPYDADNAPTVPFINPPFVSSDGFQEKPLGVLSLRLADPVTTKNGAVTLKLGEGVDLDDSGKLISKNATKATAPLSISNNTISLNMDTPLYNNNGKLGMKVTAPLKILDTDLLKTLVVAYGQGLGTNTNGALVAQLAYPLVFNTASKIALNLGNGPLKVDANRLNINCKRGIYVTTTKDALEINISWANAMTFIGNAIGVNIDTKKGLQFGTSSTETDVKNAFPLQVKLGAGLTFDSTGAIVAWNKEDDKLTLWTTADPSPNCHIYSAKDAKLTLCLTKCGSQILGTVSLIAVDTGSLNPITGKVTTALVSLKFDANGVLQASSTLDKEYWNFRKGDVTPADPYTNAIGFMPNLNAYPKNTNAAAKSHIVGKVYLHGDVSKPLDLIITFNETSDESCTYCINFQWRWGTDQYKDETLAVSSFTFSYIAKE

SEQ ID NO: 80 - protein, 445 aa, Chimpanzee Adenovirus- CV23/Pan5 Fiber
MSKKRVRVDDDFDPVYPYDADNAPTVPFINPPFVSSDGFQEKPLGVLSLRLADPVTTKNGEITLKLGDGVDLDSSGKLISNTATKAAAPLSFSNNTISLNMDTPFYNNNGKLGMKVTAPLKILDTDLLKTLVVAYGQGLGTNTTGALVAQLASPLAFDSNSKIALNLGNGPLKVDANRLNINCNRGLYVTTTKDALEANISWANAMTFIGNAMGVNIDTQKGLQFGTTSTVADVKNAYPIQIKLGAGLTFDSTGAIVAWNKDDDKLTLWTTADPSPNCHIYSEKDAKLTLCLTKCGSQILGTVSLIAVDTGSLNPITGTVTTALVSLKFDANGVLQSSSTLDSDYWNFRQGDVTPAEAYTNAIGFMPNLKAYPKNTSGAAKSHIVGKVYLHGDTGKPLDLIITFNETSDESCTYCINFQWQWGADQYKNETLAVSSFTFSYIAKE

SEQ ID NO: 81 - protein, 443 aa, Chimpanzee Adenovirus- CV32/Pan6 Fiber; identical to SEQ ID NO: 75

SEQ ID NO: 82 - protein, 443 aa, Chimpanzee Adenovirus- CV33/Pan7 Fiber
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDTPLYTKDGKLSLQVSPPLNILKSTILNTLAVAYGSGLGLSGGTALAVQLASPLTFDEKGNIKINLASGPLTVDASRLSINCKRGVTVTTSGDAIESNISWPKGIRFEGNGIAANIGRGLEFGTTSTETDVTDAYPIQVKLGTGLTFDSTGAIVAWNKEDDKLTLWTTADPSPNCKIYSEKDAKLTLCLTKCGSQILGTVTVLAVNNGSLNPITNTVSTALVSLKFDASGVLLSSSTLDKEYWNFRKGDVTPAEPYTNAIGFMPNIKAYPKNTSAASKSHIVSQVYLNGDEAKPLMLIITFNETEDATCTYSITFQWKWDSTKYTGETLATSSFTFSYIAQE

SEQ ID NO: 83 - protein, 543 aa, Chimpanzee Adenovirus- ChAd 3 Fiber
MKRTKTSDESFNPVYPYDTESGPPSVPFLTPPFVSPDGFQESPPGVLSLNLAEPLVTSHGMLALKMGSGLSLDDAGNLTSQDITTASPPLKKTKTNLSLETSSPLTVSTSGALTVAAAAPLAVAGTSLTMQSEAPLTVQDAKLTLATKGPLTVSEGKLALQTSAPLTAADSSTLTVSATPPINVSSGSLGLDMEDPMYTHDGKLGIRIGGPLRVVDSLHTLTVVTGNGLTVDNNALQTRVTGALGYDTSGNLQLRAAGGMRIDANGQLILNVAYPFDAQNNLSLRLGQGPLYINTDHNLDLNCNRGLTTTTTNNTKKLETKISSGLDYDTNGAVIIKLGTGLSFDNTGALTVGNTGDDKLTLWTTPDPSPNCRIHSDKDCKFTLVLTKCGSQILASVAALAVSGNLASITGTVASVTIFLRFDQNGVLMENSSLDRQYWNFRNGNSTNAAPYTNAVGFMPNLAAYPKTQSQTAKNNIVSQVYLNGDKSKPMTLTITLNGTNESSETSQVSHYSMSFTWAWESGQYATETFATNSFTFSYIAEQ

SEQ ID NO: 84 - protein, 445 aa, Chimpanzee Adenovirus- ChAd 6 Fiber
MSKKRARVDDDFDPVYPYDADNAPTVPFINPPFVSSDGFQEKPLGVLSLRLADPVTTKNGAVTLKLGEGVDLDDSGKLISKNATKATAPLSISNNTISLNMDTPLYNNNGKLGMKVTAPLKILDTDLLKTLVVAYGQGLGTNTNGALVAQLAYPLVFNTASKIALNLGNGPLKVDANRLNINCKRGIYVTTTKDALEINISWANAMTFIGNAIGVNIDTKKGLQFGTSSTETDVKNAFPLQVKLGAGLTFDSTGAIVAWNKEDDKLTLWTTADPSPNCHIYSAKDAKLTLCLTKCGSQILGTVSLIAVDTGSLNPITGKVTTALVSLKFDANGVLQASSTLDKEYWNFRKGDVTPADPYTNAIGFMPNLNAYPKNTNAAAKSHIVGKVYLHGDESKPLDLIITFNETSDESCTYCINFQWQWGTDQYKDETLAVSSFTFSYIAKE

SEQ ID NO: 85 - protein, 322 aa, Chimpanzee Adenovirus- C1 Fiber
MAKRTRLSSSFNPVYPYEDENSSHPFINPGFISPNGFTQSPDGVLTLNCVAPLTTANGALDIKVGGGLKVNSTDGFLEENINITSPLTKSNHSIGLEWSDGLQTNEAKLCVKLGKGLVFDSSSAIAMENNTLWTGAKPSANCVIKEGEDSPDCKLTLVLVKNGGLVNGYITLMGDSEYTNTLFKNKQVTIDVNLAFDNTGQIITYLSSLKSNLNFKDNQNMATGTITSAKGFMPSTTAYPFITYATQSLNEDYIYGECYYKSTNGTLFPLKVTVTLNRRMSASGMAYAMNFSWSLNAEEAPETTEVTLITSPFFFSYIREDD

SEQ ID NO: 86 - protein, 425 aa, Chimpanzee Adenovirus- CV68 Fiber; identical to SEQ ID NO: 49

SEQ ID NO: 87 - protein, 954 aa, Chimpanzee Adenovirus- ChAd20 Hexon
MATPSMMPQWSYMHISGQDASEYLSPGLVQFARATESYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNPCEWDEAATALDIDLNAEDDEESDEAQGEADQQKTHVFGQAPYSGQNITKEGIQIGIDAASQAQTPVYADKTFQPEPQVGESQWNETEISYGAGRVLKKTTLMKPCYGSYARPTNENGGQGILLEQDGKKESQVEMQFFSTTQAAAGNSDNPTPKVVLYSEDVNLETPDTHISYMPTNNETNSRELLGQQAMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGVINTETFTKVKPKAAQDAQWEKDSEFSDKNEIRVGNNFAMEINLNANLWRNFLYSNVALYLPDKLKYTPSNVQISNNPNSYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLVQMLANYNIGYQGFYIPESYKDRMYSFFRNFQPMSRQVVDQTKYKDYQEVGIIHQHNNSGFVGYLAPTMREGQAYPANFPYPLIGKTAVDSITQKKFLCDRTLWRIPFSSNFMSMGALSDLGQNLLYANSAHALDMTFEVDPMDEPTLLYVLFEVFDVVRVHQPHRGVIETVYLRTPFSAGNATT

SEQ ID NO: 88 - protein, 940 aa, Chimpanzee Adenovirus- ChAd 4 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQKKTGNNANGDTENVTYGVAAMGGIDIDKNGLQIGTDDTKDDDNEIYADKTYQPEPQIGEENWQETYSYYGGRALKKDTKMKPCYGSFARPTNVKGGQAKIKTDGDVKSFDIDLAFFDIPNSGAGNGTNVNDDPDMVMYTENVNLETPDTHIVYKPGTSDDSSKVNLCQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNSVYQGVKPKTDNGNDQWETDSTVSSHNQICKGNIYAMEINLQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 89 - protein, 940 aa, Chimpanzee Adenovirus- ChAd 5 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQKKTGNNANGDTENVTYGVAAMGGIDIDKNGLQIGTDDTKDDDNEIYADKTYQPEPQIGEENWQETYSYYGGRALKKDTKMKPCYGSFARPTNVKGGQAKIKTDGDVKSFDIDLAFFDIPNSGAGNGTNVNDDPDMVMYTENVNLETPDTHIVYKPGTSDDSSKVNLCQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNSVYQGVKPKTDNGNDQWETDSTVSSHNQICKGNIYAMEINLQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGKATT

SEQ ID NO: 90 - protein, 940 aa, Chimpanzee Adenovirus- ChAd 7 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQKKTGKNANGDTENVTYGVAAMGGIDIDKNGLQIGTDDTKDGDNEIYADKTYQPEPQIGEENWQETYSYYGGRALKKDTKMKPCYGSFARPTNVKGGQAKIKTDGDVKSFDIDLAFFDIPNSGAGNGTNVNDDPDMVMYTENVNLETPDTHIVYKPGTSDDSSEVNLCQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNSVYQGVKPKTDNGNDQWETDSTVSSHNQICKGNIYAMEINLQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 91 - protein, 930 aa, Chimpanzee Adenovirus- ChAd 9 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTCQWTYTDNQTEKTATYGNAPVEGINITKDGIQLGTDSDGQAIYADETYQPEPQVGDPEWHDTTGTEEKYGGRALKPATDMKPCYGSFAKPTNVKGGQAKSRTKTDGTTEPDIDMAFFDGRNATTAGLTPEIVLYTENVDLETPDTHIVYKAGTDDSSSSINLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLNAVGRTNSYQGIKPNGGDPATWAKDESVNDSNELGKGNPFAMEINIQANLWRNFLYANVALYLPDSYKYTPANITLPANTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 92 - protein, 930 aa, Chimpanzee Adenovirus- ChAd 10 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTCQWTYTDNQTEKTATYGNAPVQGISITKDGIQLGTDTDDQPIYADKTYQPEPQVGDAEWHDITGTDEKYGGRALKPDTKMKPCYGSFAKPTNKEGGQANVKTETGGTKEYDIDMAFFDNRSAAAAGLAPEIVLYTENVDLETPDTHIVYKAGTDDSSSSINLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLNAVGRTDTYQGIKANGADQTTWTKDDTVNDANELGKGNPFAMEINIQANLWRNFLYANVALYLPDSYKYTPANITLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 93 - protein, 960 aa, Chimpanzee Adenovirus- ChAd 11 Hexon
MATPSMMPQWSYMHISGQDASEYLSPGLVQFARATESYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQEETQAVEEAAEEEEEDADGQAEEEQAATKKTHVYAQAPLSGEKISKDGLQIGTDATATEQKPIYADPTFQPEPQIGESQWNEADATVAGGRVLKKTTPMKPCYGSYARPTNANGGQGVLAANAQGQLESQVEMQFFSTSENARNEANNIQPKLVLYSEDVHMETPDTHLSYKPTKSDDNSKVMLGQQAMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGIGVTDTYQAVKTNNGNNGGQVTWTKDETFAERNEIGVGNNFAMEINLNANLWRNFLYSNVALYLPDKLKYNPSNVDISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLVQMLANYNIGYQGFYIPESYKDRMYSFFRNFQPMSRQVVDQTKYKDYQEVGIIHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 94 - protein, 944 aa, Chimpanzee Adenovirus- ChAd 16 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQTENGGGQATTKTHTYGVAPMGGTNITVDGLQIGTDATADTEKPIYADKTFQPEPQIGEENWQETESFYGGRALKKDTNMKPCYGSFARPTNEKGGQAKLKVGADGLPTKEFDIDLAFFDTPGGTVTGGTEEYKADIVMYTENTYLETPDTHVVYKPGKDNTSSKINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKNGQDGDVESEWEKDDTVAARNQLCKGNIFAMEINLQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 95 - protein, 960 aa, Chimpanzee Adenovirus- ChAd 17 Hexon
MATPSMMPQWSYMHISGQDASEYLSPGLVQFARATESYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQEETQAVEEAAEEEEEDADGQAEEEQAATKKTHVYAQAPLSGEKISKDGLQIGTDATATEQKPIYADPTFQPEPQIGESQWNEADATVAGGRVLKKSTPMKPCYGSYARPTNANGGQGVLTANAQGQLESQVEMQFFSTSENARNETNNIQPKLVLYSEDVHMETPDTHLSYKPAKSDDNSKIMLGQQSMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGIGVTDTYQAVKTNNGNNGGQVTWTKDETFADRNEIGVGNNFAMEINLSANLWRNFLYSNVALYLPDKLKYNPSNVDISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLVQMLANYNIGYQGFYIPESYKDRMYSFFRNFQPMSRQVVDQTKYKDYQEVGIIHQHNNSGFVGYLAPTMREGQAYPANFPYPLIGKTAVDSITQKKFLCDRTLWRIPFSSNFMSMGALSDLGQNLLYANSAHALDMTFEVDPMDEPTLLYVLFEVFDVVRVHQPHRGVIETVYLRTPFSAGNATT

SEQ ID NO: 96 - protein, 958 aa, Chimpanzee Adenovirus- ChAd 19 Hexon
MATPSMMPQWSYMHISGQDASEYLSPGLVQFARATESYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQLEEAQAALEDEELEDEDEEPQDEAPVKKTHVYAQAPLSGEEITKDGLQIGSDNTEAQSKPIYADPTFQPEPQIGESQWNEADATVAGGRVLKKTTPMKPCYGSYARPTNANGGQGVLVADDKGVLQSKVELQFFSNTTTLNQREGNDTKPKVVLYSEDVHMETPDTHISYKPTKSDDNSKVMLGQQSMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGIGVTDTYQVIKTNGNGQADPTWEKDTEFADRNEIGVGNNFAMEINLNANLWRNFLYSNVALYLPDKLKYNPSNVDISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLVQMLANYNIGYQGFYIPESYKDRMYSFFRNFQPMSRQVVDQTKYKDYQEVGIIHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 97 - DNA, 2865 bp, Chimpanzee Adenovirus- ChAd 8 Hexon
atggccaccccatcgatgttgccccagtgggcatacatgcacatcgccggacaggatgcttcggagtacctgagtccgggtctggtgcagttcgcccgtgccacagacacctacttcaatctggggaacaagtttaggaaccccaccgtggcccccacccacgatgtgaccaccgaccgaagccagcggctgatgctgcgctttgtgcccgttgatcgggaggacaatacctactcatacaaagttcgctacacactggctgtgggcgacaacagagtgctggatatggccagcaccttctttgacatccggggggtgcttgacagaggtcccagtttcaagccatactctggcacggcttacaactccttggctcctaagggtgcccccaatacatgccagtggatagctaaagggtcgcccgttcaagatgatgctgaacaagctcaggaacaaaaagatgttacctatacttttggcaatgcgccagtaaaagcagaagatgacattacaaaagacggattagaagtaggcatacaaattattggtgatgaggagaatcccatttatgcagataaaacatatcaaccagagccacaggttggtgacgagcaatggcatgacacaactggaaccactgagcagtatggaggcagagctcttaagccagctacaaacatgaggccatgctatggctcttttgccagacctacaaacaaaaaaggagggcaagctaaaaccagaaaagtagaaaaaactgaaggtgacaaaaagactgaagttgaagaacttgacattgatatggatttttatgatgcaagatctaaaaaacaaggctatgatcctcaaatagtgctatattcagaaaatgtaaatctggaaacgcccgacactcatattgtgtacaaaccgggaactgatgaaaccagttcctccactaatttgggccagcaagctatgcccaacagacccaattacattggtttcagggacaacttcattggacttatgtattataacagtactggtaacatgggagtgctggccggtcaagcttctcagttgaatgctgtggtcgacttgcaggacaggaacacagaactgtcctaccagctgctgcttgactctctgggtgacagaaccagatactttagcatgtggaatcaggccgtggatagctatgacccagatgtgcgcattattgaaaatcatggtgtggaagatgaacttcccaattattgtttcccattggatggtgttggtccaattacagaaacctatcaaggtatcaagccaaaaacagcagacaatgcaaatgaccaatgggaaaaaaataccgaagtaaatggagctaatgaaataggaaagggaaacaattatgcaatggaaattaatctacaagctaacctctggagaagttttctttactccaacgtggctctgtatcttccagacggttacaaatataccccagccaatgttacgctgccagacaacaaaaatacctatgggtacataaacggacgagtagtgtctccatctttggtggattcatacatcaacattggagccagatggtctttggatcttatggacaatgtcaacccatttaatcaccaccgcaatgctgggctgcgctaccgttccatgcttcttggcaatggacgctatgtgcccttccacatccaagtgccgcagaaattctttgctatcaagaacttgctgcttctgccaggctcctacacctatgagtggaacttcagaaaggatgtgaacatggtcctacaaagttcccttggtaatgatctcagaactgatggagccagcatcagttttaccagcatcaacctctatgccacctttttcccaatggctcacaacactgcttccacccttgaagccatgctgcgcaatgacaccaatgaccagtcattcaacgactacctctctgcagccaacatgctctaccccatccctgccaatgccactaacattcccatctccattccctctcgcaactgggctgccttcaggggctggtccttcaccagactcaaaaccaaggagactccctctttgggatcagggttcgatccctactttgtctattcaggctccattccctacctggatggtaccttctacctcaaccacactttcaagaaggtctccatcatgtttgactcctcagtcagctggccgggcaatgacagactgttgtgtcccaatgagtttgaaatcaagcgcactgtggatggggaagggtacaacgtggctcaatgcaacatgaccaaggattggttcttggtccagatgcttgccaactacaacattggctaccagggcttctacatcccagaggggtacaaggatcgcatgtactccttcttcagaaacttccagcccatgagcagacaggtagttgatgaagtcaattacaaggagtaccaagctgtcacacttgcttaccagcacaacaactctggttttgtgggttaccatgcacccactcttcgtcagggccaaccatacccagctaactacccctacccgctcattggaaccactgctgtcaccagcgtcacccagaaaaagttcttgtgcgacaggaccatgtggcgcatcccattctccagcaacttcatgtccatgggtgcccttaccgacctggggcagaacatgctttatgccaactcagcccatgcgctggacatgacttttgaggtggatcccatggatgagcccacactgctttatcttctttttgaagtcttcgacgtggtcagagtgcaccagccacaccgcggcgtcatcgaggctgtctacctgcgtaccccattctcagctggtaacgccaccacataa

SEQ ID NO: 98 - protein, 954 aa, Chimpanzee Adenovirus ChAd 8
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGTAYNSLAPKGAPNTCQWIAKGSPVQDDAEQAQEQKDVTYTFGNAPVKAEDDITKDGLEVGIQIIGDEENPIYADKTYQPEPQVGDEQWHDTTGTTEQYGGRALKPATNMRPCYGSFARPTNKKGGQAKTRKVEKTEGDKKTEVEELDIDMDFYDARSKKQGYDPQIVLYSENVNLETPDTHIVYKPGTDETSSSTNLGQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGVGPITETYQGIKPKTADNANDQWEKNTEVNGANEIGKGNNYAMEINLQANLWRSFLYSNVALYLPDGYKYTPANVTLPDNKNTYGYINGRVVSPSLVDSYINIGARWSLDLMDNVNPFNHHRNAGLRYRSMLLGNGRYVPFHIQVPQKFFAIKNLLLLPGSYTYEWNFRKDVNMVLQSSLGNDLRTDGASISFTSINLYATFFPMAHNTASTLEAMLRNDTNDQSFNDYLSAANMLYPIPANATNIPISIPSRNWAAFRGWSFTRLKTKETPSLGSGFDPYFVYSGSIPYLDGTFYLNHTFKKVSIMFDSSVSWPGNDRLLCPNEFEIKRTVDGEGYNVAQCNMTKDWFLVQMLANYNIGYQGFYIPEGYKDRMYSFFRNFQPMSRQVVDEVNYKEYQAVTLAYQHNNSGFVGYHAPTLRQGQPYPANYPYPLIGTTAVTSVTQKKFLCDRTMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 99 - DNA, 2871 bp, Chimpanzee Adenovirus- ChAd 22 Hexon
atggccaccccatcgatgctgccccagtgggcatacatgcacatcgccggacaggatgcttcggagtacctgagtccgggtctggtgcagttcgcccgcgccacagacacctacttcaatctggggaacaagtttaggaaccctaccgtggcgcccacccatgatgtgaccaccgaccgcagtcaacggctgatgctccgctttgtgcccgttgaccgggaggacaatacctactcatacaaagttcgatacaccttggctgtgggcgacaacagagtgctggatatggccagtactttctttgacattcggggtgtgttggatagaggccctagcttcaagccatattctggcactgcttacaactcattggcccctaagggcgctcccaatacatctcagtggattgctgaaggcgtaaaaaaagaaaatggggaagctgacaatgaagcagctgtcgaagaggaagaggaagagaaaaatcttaccacttacacttttggaaatgccccagtgaaagcagaaggtggtgatatcactaaagacaaaggtcttccaattggttcagaaattacagacggcgaagccaaaccaatttatgcagataaactataccaaccagaacctcaggtgggagaggaaacttggactgacacagatggaacaactgagaagtatggtggtagagctctaaagccagaaactaaaatgaaaccctgctatgggtcttttgctaaacccactaacgtcaaaggcggacaggcaaaacaaaaaactactgaacaactgcaaaaccagcaggttgaatatgatattgacatgaacttttttgatcaagcgtcacagaaagcaaacttcagtccaaaaattgtgatgtatgcagaaaatgtagacttggaaaccccagacactcacgtggtgtacaaacctggtacttcagaagaaagttctcatgctaatctcggtcaacaatctatgcccaacagacccaactacattggctttagagataactttattggacttatgtactacaacagtactggcaacatgggagtgctggcaggtcaagcatcccaattgaatgcggtggttgacttgcaggacagaaacacagaactatcatatcaactactgcttgattctctgggtgacagaaccagatacttcagcatgtggaatcaagcagtcgatagctatgatcctgatgtgcgcattattgaaaatcatggggtggaagatgagcttcccaactactgctttccattggatggagtaggggtaccaacaactagttacaaaataattgaaccaaatggagagggtgcagattggaaagagcctgacataaatggaacaagtgaaattggacaaggaaatctctttgccatggaaattaacctccaagctaatctctggagaagttttctttattccaatgtggctctgtatctcccagactcctacaaatacaccccagccaatgtcactcttccaactaacaccaacacttatgactacatgaatgggcgggtggttcccccatccctagtggatacctacgtaaacattggcgccagatggtctttggatgccatggacaatgtcaacccctttaaccatcaccgcaacgctggcctgcgataccggtccatgcttttgggcaatggtcgctacgtgcctttccacattcaagtgcctcagaaattctttgctgtgaagaacctgctgcttctacccggttcttacacctacgagtggaacttcagaaaggatgtgaacatggtcctgcagagttcccttggtaatgatctccgggtcgatggtgccagcatcagttttaccagcatcaatctctatgccaccttcttccccatggcccacaacactgcctccacccttgaagccatgctgcgcaatgacaccaatgatcaatcattcaatgactacctttctgcagccaacatgctctaccccatcccggccaacgctaccaacgttcccatctccattccctctcgtaactgggccgccttcagaggctggtccttcaccagactcaaaaccaaagagactccctctttgggatcagggttcgatccctactttgtttactctggttctataccttacctggatggtaccttctaccttaaccacacttttaagaaagtctctatcatgtttgactcttcagtcagctggcctggtaatgacagattgctaactccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcagcccatgcgctggacatgacttttgaggtggatcccatggatgagcccaccctgctttatcttctttttgaagtattcgacgtggtcagagtgcaccaaccacaccgcggcgtcatcgaggccgtctacctgcgcacaccgttctcggctggtaacgccaccacataa

SEQ ID NO: 100 - protein, 956 aa, Chimpanzee Adenovirus- ChAd 22 Hexon
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGTAYNSLAPKGAPNTSQWIAEGVKKENGEADNEAAVEEEEEEKNLTTYTFGNAPVKAEGGDITKDKGLPIGSEITDGEAKPIYADKLYQPEPQVGEETWTDTDGTTEKYGGRALKPETKMKPCYGSFAKPTNVKGGQAKQKTTEQLQNQQVEYDIDMNFFDQASQKANFSPKIVMYAENVDLETPDTHVVYKPGTSEESSHANLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGVGVPTTSYKIIEPNGEGADWKEPDINGTSEIGQGNLFAMEINLQANLWRSFLYSNVALYLPDSYKYTPANVTLPTNTNTYDYMNGRVVPPSLVDTYVNIGARWSLDAMDNVNPFNHHRNAGLRYRSMLLGNGRYVPFHIQVPQKFFAVKNLLLLPGSYTYEWNFRKDVNMVLQSSLGNDLRVDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYVPEGYKDRMYSFFRNFQPMSRQVVDEINYKDYKAVAVPYQHNNSGFVGYMAPTMRQGQAYPANYPYPLIGTTAVTSVTQKKFLCDRTMWRIPFSSNFMSMGALTDLGQNLLYANSAHALDMTFEVDPMDEPTLLYLLFEVFDVVRVHQPHRGVIEAVYLRTPFSAGNATT

SEQ ID NO: 101 - DNA, 2865 bp, Chimpanzee Adenovirus- ChAd 24 Hexon
atggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtcccagcgcctgacgctgcggttcatccccgtggaccgcgaggacaccgcgtactcgtacaaggcgcggttcaccctggccgtgggcgacaaccgcgtgctggacatggcctccacctactttgacatccgcggcgtgctggaccgcggccccaccttcaagccctactccggcaccgcctacaactccctggcccccaagggcgcgcccaacccatgcgagtgggatgaggctgctactgcccttgacattgatttgaacgcagaagaagatgaagaaggcgatgaagcccaaggggaagcagatcagcagaaaactcatgtatttggccaggcgccatactccggacagaacattacaaaagaaggcatacagataggcattgatgctaccagtcaagcccaaacacctctatatgccgacaaaacattccaacccgaacctcaggttggagaatcacaatggaatgagacagagattagccatggagcgggacgggtgctaaaaaagaccactctcatgaaaccttgctatgggtcatatgcaaggcctactaatgagaacggaggtcagggcatcctcctggaacaagatggaaagaaagaaagtcaagtggaaatgcaatttttctccactactcaggcagctgcgggtaattcagataatcctactccaaagcttgttttgtacagcgaggatgttaacctggaaacaccagatacacacatttcatacatgcccactaacaacgaaaccaattcaagagaactgttgggacaacaggccatgcccaacaggcctaattacatcggcttcagagacaactttatcggtctcatgtactacaacagcactggcaacatgggagtgcttgcaggtcaggcctctcagttgaatgcagtggtggacttgcaagacagaaacacagaactgtcctaccagctcttgcttgattccatgggtgacagaaccagatatttctccatgtggaatcaggcagtggacagttatgacccagatgtcagaattattgaaaatcatggaaccgaagacgagctccccaactactgttttcctctgggtggcataatcaatacggaaacttttacaaaagtcaagcctaaagctggacaggacgctcagtgggaaaaagattcagaattttcagataaaaatgaaataagagtgggaaacaacttcgctatggaaatcaacatcaatgccaacctgtggaggaacttcctgtactccaacgtggccctgtacctgccagacaagcttaagtatactccatccaatgtgcaaatttccaacaaccccaactcctacgattacatgaacaagcgagtggtggccccggggctggtggactgctacatcaacctgggcgcgcggtggtcgctggactacatggacaacgtcaaccccttcaaccaccaccgcaacgcgggcctgcgctaccgctccatgctcctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggcaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctctccgccgccaacatgctctaccccatccccgccaacgccaccaacgtccccatctccatcccctcgcgcaactgggcggccttccgcggctgggccttcacccgcctcaagaccaaggagaccccctccctgggctcgggattcgacccctactacacctactcgggatccattccctacctggacggcaccttctacctcaaccacactttcaagaaggtctcggtcaccttcgactcctcggtcagctggccgggcaacgaccgcctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctacccgctcataggcaagaccgcggtcgacagcatcacccagaaaaagttcctctgcgaccgcaccctctggcgcatccccttctccagcaacttcatgtccatgggtgcgctcacggacctgggccagaacctgctctatgccaactccgcccacgcgctcgacatgaccttcgaggtcgaccccatggacgagcccacccttctctatgttctgttcgaagtctttgacgtggtccgggtccaccagccgcaccgcggcgtcatcgagaccgtgtacctgcgcacgcccttctcggccggcaacgccaccacctaa

SEQ ID NO: 102 - protein, 954 aa, Chimpanzee Adenovirus- ChAd 24 Hexon
MATPSMMPQWSYMHISGQDASEYLSPGLVQFARATESYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNPCEWDEAATALDIDLNAEEDEEGDEAQGEADQQKTHVFGQAPYSGQNITKEGIQIGIDATSQAQTPLYADKTFQPEPQVGESQWNETEISHGAGRVLKKTTLMKPCYGSYARPTNENGGQGILLEQDGKKESQVEMQFFSTTQAAAGNSDNPTPKLVLYSEDVNLETPDTHISYMPTNNETNSRELLGQQAMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGIINTETFTKVKPKAGQDAQWEKDSEFSDKNEIRVGNNFAMEININANLWRNFLYSNVALYLPDKLKYTPSNVQISNNPNSYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLVQMLANYNIGYQGFYIPESYKDRMYSFFRNFQPMSRQVVDQTKYKDYQEVGIIHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 103 - DNA, 2841 bp, Chimpanzee Adenovirus- ChAd 26 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaaaaaaagacaggcaataacaatggaaatggcggcactgaatctgttacctttggtgtagccgccatgggcggagagaatattacaaaagagggtcttcaaattggaagtgatgaaactaaaaccgataacaaagaaatttatgcagacaagacctaccaacctgagcctcaaataggagaggagaactggcaagaaacattctctttttatggtggtagagctcttaaaaaagatactaagatgaaaccatgctatggctcctttgctaggcccacaaatgaaaagggaggtcaggccaaatttaaagttcaagacggtgtgcagactacagaatatgacatcgacctggctttctttgatattccaagcaccggcacagggggcaatggtacaaatgtaaatgataagccagacatggtcatgtacactgaaaatgtgaatttggagacgccagatactcatattgtgtacaaacctggaacttcagatgacagctctaaagccaacttgtgccagcaggccatgccaaacagacccaactacattggtttcagagacaactttattgggctcatgtattacaacagtactggcaatatgggggtgctggctggtcaggcctctcagctgaatgctgtggtcgacttgcaagacagaaacaccgaactgtcttaccagctcttgctcgactctctgggtgacagaaccaggtatttcagtatgtggaaccaggcggtggacagttatgaccctgatgtgcgcattattgaaaaccatggtgtggaggatgaattgccaaactattgcttccccttggatggagctggcactaatgctgtataccagggtgttaaagcaaaagataacggaaacgcagccaatggaaactgggaacaagacacaggcgtttcaagtattaaccagatatgcaaggggaacatctatgccatggaaatcaacattcaagccaacctgtggagaagtttcctttactcgaacgtggccctgtacctgcccgactcttacaagtacacgccggccaacatcaccctgcccaccaacaccaacacctacgattacatgaacggtcgggtggtgcctccctcgctggtggacgcctacatcaacatcggggcgcgctggtcgctggaccccatggacaacgtcaatcccttcaaccaccaccgcaacgcgggcctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcttccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggaaacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggcaacgccaccacctaa

SEQ ID NO: 104 - protein, 946 aa, Chimpanzee Adenovirus- ChAd 26 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQKKTGNNNGNGGTESVTFGVAAMGGENITKEGLQIGSDETKTDNKEIYADKTYQPEPQIGEENWQETFSFYGGRALKKDTKMKPCYGSFARPTNEKGGQAKFKVQDGVQTTEYDIDLAFFDIPSTGTGGNGTNVNDKPDMVMYTENVNLETPDTHIVYKPGTSDDSSKANLCQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNAVYQGVKAKDNGNAANGNWEQDTGVSSINQICKGNIYAMEINIQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 105 - DNA, 2838 bp, Chimpanzee Adenovirus- ChAd 30 Hexon
atggccaccccatcgatgctgccccagtgggcatacatgcacatcgccggacaggatgcttcggagtacctgagtccgggtctggtgcagttcgcccgtgccacagacacctacttcaatctggggaacaagtttaggaaccccaccgtggcacccacccacgatgtgaccaccgaccgaagccagcggctgatgctgcgctttgtgcccgttgatcgtgaggacaatacttactcgtacaaagttcgttacacactggctgtgggcgacaacagagtgctagatatggccagcaccttctttgacatcagaggggtgcttgacagaggtcccagcttcaagccctactctggcacagcttacaactctctggctcctaagggagctcctaatcctagccaatggctagaacaatcaacgacagagggagaagacgatccaactaacactacacacacatttggaatagcttctatgaaaggagaaaacatcaccaaagaaggtttgcaaattggaaaagaagtaaccactactggagataaaccaatttatgcagataaaacctttcagccagaaccccaagtgggagaagagacttggactgatactgacgggacaaatgaaaagtttggcggtagaactcttaaaagtgctactaatatgaaaccatgctatgggtcttttgctaggcccacaaacaaacaaggcggacaagctaaaaccagaaaagtagcggcagttgatgggggggaggaaactgaagaaccagacatcgacatggtgttttatgatgatagaggtgctacagaagccatgatggctcctgaagttgtactttatgcagaaaatgtaaatctggaaacaccagacacccatgtggtgtacaaaccaggaacctctgatattaattctcatgaaaatttgggtcagcaggctatgccaaacaggcccaattacattggattcagagataactttgttggactcatgtactacaatagtactggcaatatgggtgtgttggcagggcaggcatcacagctaaatgcagtagttgacttgcaagacagaaacactgagctatcgtaccagctcttacttgattccctgggcgacagaactcgatatttcagcatgtggaaccaggctgtggatagctatgaccctgatgtgcgcattattgaaaatcatggtatcgaagatgaactaccaaattactgcttccctcttgatggaataggaccaggtaaaacataccaaggtattaaagaaaaacaaggtgatgaggccaacaaatgggaacaagacaaaacctatgccacctctaatgaaatagccataggtaataacctggctatggaaattaatatccaggctaacctttggagaagttttctgtactccaacgtggctctgtaccttccagacgcttacaagtacacgccggccaacattactttacctgccaataccaacacctatgaatacatgaacgggcgagtggtggcaccatctttggttgattcctacatcaacattggtgccaggtggtctcttgacccaatggacaatgtgaaccccttcaatcaccaccgcaacgctgggctgcgttacagatccatgcttctgggcaatggtcgctatgtgcctttccacatccaagtgcctcaaaaattctttgctatcaaaaacctgcttctcctccccggatcctacacctatgagtggaacttcagaaaggacgtaaacatggtcctgcagagttcccttggtaatgatctcagaactgatggtgctagcattagttttaccagcatcaacctctatgccacctttttcccaatggctcacaacactgcttccacacttgaagccatgctgcgcaatgacaccaatgaccagtcattcaatgactacctttctgcagctaacatgctctacccaattccagcaaatgctaccaacattcccatttccattccctctcgcaactgggctgccttcaggggctggtcattcaccagactcaaaaccaaggagactccctctttgggatcaggctttgatccctactttgtttactctggctccattccctacctggatggtaccttctacctcaaccacactttcaaaaaggtttccattatgtttgattcctcagtcagctggccgggcaatgacagattgctaactccaaatgagttcgaaatcaagcgcactgtggatggggaagggtacaatgtagctcaatgcaacatgaccaaggactggttcctggttcagatgcttgccaactataacattggctaccagggcttctacatcccagaggggtacaaggatcgcatgtattccttcttcagaaacttccagcccatgagcagacaggtggttgatgaagttaattacaaggagtaccaagccgtcacacttgcttaccaacacaacaactctggctttgtgggttaccttgcacccactatgaggcagggagaaccttaccccgctaactacccataccccctaatcggaaccactgctgttaagagtgttacccacaaaaagttcctgtgcgacaggaccatgtggcgcatccccttctccagcaacttcatgtccatgggtgcccttaccgacctgggacagaacatgctttatgccaactcatcccatgcgctggacatgacttttgaggtggatcccatggatgagcccaccctgctttatcttcttttcgaagttttcgacgtggtcagagcgcaccagccacaccgcggcgtcatcgaggctgtctacctgcgtactccattctcagctggtaacgccaccacataa

SEQ ID NO: 106 - protein, 945 aa, Chimpanzee Adenovirus- ChAd 30 Hexon
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGTAYNSLAPKGAPNPSQWLEQSTTEGEDDPTNTTHTFGIASMKGENITKEGLQIGKEVTTTGDKPIYADKTFQPEPQVGEETWTDTDGTNEKFGGRTLKSATNMKPCYGSFARPTNKQGGQAKTRKVAAVDGGEETEEPDIDMVFYDDRGATEAMMAPEVVLYAENVNLETPDTHVVYKPGTSDINSHENLGQQAMPNRPNYIGFRDNFVGLMYYNSTGNMGVLAGQASQLNAVVDLQDRNTELSYQLLLDSLGDRTRYFSMWNQAVDSYDPDVRIIENHGIEDELPNYCFPLDGIGPGKTYQGIKEKQGDEANKWEQDKTYATSNEIAIGNNLAMEINIQANLWRSFLYSNVALYLPDAYKYTPANITLPANTNTYEYMNGRVVAPSLVDSYINIGARWSLDPMDNVNPFNHHRNAGLRYRSMLLGNGRYVPFHIQVPQKFFAIKNLLLLPGSYTYEWNFRKDVNMVLQSSLGNDLRTDGASISFTSINLYATFFPMAHNTASTLEAMLRNDTNDQSFNDYLSAANMLYPIPANATNIPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYIPEGYKDRMYSFFRNFQPMSRQVVDEVNYKEYQAVTLAYQHNNSGFVGYLAPTMRQGEPYPANYPYPLIGTTAVKSVTHKKFLCDRTMWRIPFSSNFMSMGALTDLGQNMLYANSSHALDMTFEVDPMDEPTLLYLLFEVFDVVRAHQPHRGVIEAVYLRTPFSAGNATT

SEQ ID NO: 107 - DNA, 2877 bp, Chimpanzee Adenovirus- ChAd 31 Hexon
atggcgaccccatcgatgatgccgcagtggtcgtacatgcacatctcgggccaggacgcctcggagtacctgagccccgggctggtgcagttcgcccgcgccaccgagagctacttcagcctgagtaacaagtttaggaaccccacggtggcgcccacgcacgatgtgaccaccgaccggtctcagcgcctgacgctgcggttcattcccgtggaccgcgaggacaccgcgtactcgtacaaggcgcggttcaccctggccgtgggcgacaaccgcgtgctggacatggcctccacctactttgacatccgcggggtgctggaccggggccccactttcaagccttactctggcaccgcctacaactccctggcccccaagggcgctcccaactcctgcgagtgggagcaattagaagaagcccaggccgctgtggaagacgaagaattagaagatgaagacgaggaaccacaggatgaggcacctgtgaaaaaaacccatgtatacgctcaggctcccctttctggagaagaaattactaaaaacggtttgcaaatagggtcagataacacagaagcccagtctaagcccatatatgcagatcctacattccagcctgaaccccaaatcggggaatcccagtggaatgaggcagatgctacagttgccggcggtagagtgctaaagaaatccactcccatgaagccatgctatggttcctatgcaagacccacaaactccaatggaggtcaaggtgtgctggtggctgatgataagggggttcttcaatctaaagttgaattgcaatttttttcaaatactactactcttaatcagcgggagggtaacgatacaaaaccaaaagtggtgctgtatagcgaagatgtgcacatggaaactccagacacccacatttcttacaagcccacaaaaagcgatgacaattcaaaaatcatgctgggtcagcagtccatgcccaacagacctaattacatcggcttcagagacaactttatcggcctcatgtattacaatagcactggcaacatgggagtgcttgcaggtcaggcctctcagttgaatgcagtggtggacttgcaagacagaaacacagaactgtcctaccagctcttgcttgattccatgggtgacagaaccagatacttttccatgtggaatcaggcagtggacagttatgacccagatgtcagaattattgaaaatcatggaactgaagacgagctccccaactattgtttccctctgggcggcataggggtaactgacacttaccaggccattaaaaccaatggcaatggtcaagaaaacccaacctgggaaaaagatacagagtttgcagaccgcaatgaaataggggtgggaaacaattttgctatggagatcaacctcagtgccaacctgtggagaaacttcctgtactccaacgtggcgctgtacctaccagacaagcttaagtacaacccctccaatgtggacatctctgacaaccccaacacctacgattacatgaacaagcgagtggtggccccggggctggtggactgctacatcaacctgggcgcgcgctggtcgctggactacatggacaacgtcaaccccttcaaccaccaccgcaatgcgggcctgcgctaccgctccatgctcctgggcaacgggcgctatgtgcccttccacatccaggtgccccagaagttctttgccatcaagaacctcctcctcctgccgggctcctacacctacgagtggaacttcaggaaggatgtcaacatggtcctccagagctctctgggtaacgatctcagggtggacggggccagcatcaagttcgagagcatctgcctctacgccaccttcttccccatggcccacaacacggcctccacgctcgaggccatgctcaggaacgacaccaacgaccagtccttcaatgactacctttccgccgccaacatgctctaccccatacccgccaacgccaccaacgtccccatctccatcccctcgcgcaactgggcggccttccgcggctgggccttcacccgcctcaagaccaaggagaccccctccctgggctcgggattcgacccctactacacctactcgggctctattccctacctggacggcaccttctacctcaaccacactttcaagaaggtctcggtcaccttcgactcctcggtcagctggccgggcaacgaccgtctgctcacccccaacgagttcgagatcaagcgctcggtcgacggggagggctacaacgtggcccagtgcaacatgaccaaggactggttcctggtccagatgctggccaactacaacatcggctaccagggcttctacatcccagagagctacaaggacaggatgtactccttcttcaggaacttccagcccatgagccggcaggtggtggaccagaccaagtacaaggactaccaggaggtgggcatcatccaccagcacaacaactcgggcttcgtgggctacctcgcccccaccatgcgcgagggacaggcctaccccgccaacttcccctacccgctcataggcaagaccgcggtcgacagcatcacccagaaaaagttcctctgcgaccgcaccctctggcgcatccccttctccagcaacttcatgtccatgggtgcgctctcggacctgggccagaacttgctctacgccaactccgcccacgccctcgacatgaccttcgaggtcgaccccatggacgagcccacccttctctatgttctgttcgaagtctttgacgtggtccgggtccaccagccgcaccgcggcgtcatcgagaccgtgtacctgcgtacgcccttctcggccggcaacgccaccacctaa

SEQ ID NO: 108 - protein, 958 aa, Chimpanzee Adenovirus- ChAd 31 Hexon
MATPSMMPQWSYMHISGQDASEYLSPGLVQFARATESYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQLEEAQAAVEDEELEDEDEEPQDEAPVKKTHVYAQAPLSGEEITKNGLQIGSDNTEAQSKPIYADPTFQPEPQIGESQWNEADATVAGGRVLKKSTPMKPCYGSYARPTNSNGGQGVLVADDKGVLQSKVELQFFSNTTTLNQREGNDTKPKVVLYSEDVHMETPDTHISYKPTKSDDNSKIMLGQQSMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGIGVTDTYQAIKTNGNGQENPTWEKDTEFADRNEIGVGNNFAMEINLSANLWRNFLYSNVALYLPDKLKYNPSNVDISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLVQMLANYNIGYQGFYIPESYKDRMYSFFRNFQPMSRQVVDQTKYKDYQEVGIIHQHNNSGFVGYLAPTMREGQAYPANFPYPLIGKTAVDSITQKKFLCDRTLWRIPFSSNFMSMGALSDLGQNLLYANSAHALDMTFEVDPMDEPTLLYVLFEVFDVVRVHQPHRGVIETVYLRTPFSAGNATT

SEQ ID NO: 109 - DNA, 2856 bp, Chimpanzee Adenovirus- ChAd 37 Hexon
atggccaccccatcgatgctgccccagtgggcatacatgcacatcgccggacaggatgcttcggagtacctgagtccgggtctggtgcagttcgcccgtgccacagacacctacttcaatctggggaacaagtttaggaaccccaccgtggcccctacccacgatgtgaccaccgaccgtagccagcggctgatgctgcgctttgtgcccgttgatcgggaggacaatacctactcttacaaagttcgctacacactggctgtgggcgacaacagagtgctggacatggccagcaccttctttgacatcaggggggtgcttgacagaggtcccagtttcaagccatactctggcacagcttacaattccctggcgcctaagggcgcgcccaatacatgccagtggattgccaagggggcgcctgttaccgatcaagacaatgaagaacaggaattaacagatgttacttacgcttttggcaatgctccagtacaagcagaagccaaaattacaaaagatggtctgccagtaggtttggaaattacagaagatgaacaaaagtcaatttatgcagacaaattgtatcagccagagccccaaattggcgatgaacaatggcatgacaccactggcactaatgaacaatacggcggcagagctctaaaaccggccaccaacatgaaaccatgttatggctcatttgccagacccacaaataaaaaaggcggtcaggctaaaactagaaaaatagaaaaggaagagaatggagttaaaaccgtaactgaagaagctgacattgatatggacttttatgacttaagatcacaaagagcaaattttgatcctaaaattgttctttattctgaaaatgtaaatttggaaactccagatacacatattgtgtataaaccaggaacagatgaaactagttcctctgttaacttgggacagcaggcaatgcccaacagacccaactacattggttttagggacaacttcattggacttatgttttacaacagtaccggcaacatgggcgtgctggccgggcaagcttctcagttaaatgctgtggttgacttgcaggacaggaacacagaactgtcctaccagctgctgcttgactctctgggtgacagaaccagatactttagcatgtggaatcaggccgtggatagctatgacccagacgtgcgcattattgaaaaccacggtgtggaagacgaacttcctaactattgttttccattagatggagtgggaccaattacgggcacttatcagggggttgagcctgatggaaacaatggaaactggaagaaaaacacaaacataaatggagcaaatgaaattggcaagggaaataactatgctatggaaattaatctacaagctaacctctggagaagttttctatattccaatgtggctctgtatttaccagacggttacaaatataccccagccaatgttacactgccagaaaacaaaaacacctatggctatataaacggacgagtagtatccccatctttggtggattcatacatcaacattggagccagatggtctttggatcttatggacaatgtaaacccattcaatcaccaccgcaatgcaggcctgcgttaccgttccatgcttttaggaaatggtcgctatgtgcctttccacatccaagtgcctcagaaaatctttgctgtcaagaacctgttgcttcttcccggctcctacacctatgagtggaacttcagaaaggacgtaaacatggtcctgcaaagttcccttggtaatgatctcagaactgatggtgctagcatcagttttaccagcatcaatctatatgctacctttttccccatggcccacaacactgcttccacccttgaagccatgctgcgcaatgacaccaatgaccagtcatttaatgactacctttctgcagctaacatgctctaccctattccagccaatgcaaccaacatccccatttccattccctctcgcaattgggccgccttcaggggctggtccttcaccagactcaaaaccaaggagaccccatctctgggatcagggttcgatccctactttgtctattctggttctattccctaccttgatggcaccttctaccttaaccacactttcaagaaggtctccatcatgtttgactcctcagtcagctggccaggcaatgacaggcttctaactccaaatgagtttgaaatcaaacgcactgtggatggggaagggtacaatgtggctcaatgcaacatgaccaaggactggttcctggttcaaatgctcgccaactacaacattggctaccagggcttctacatcccagaggggtacaaggatcgcatgtactccttcttcagaaacttccagcccatgagtaggcaggtggttgatgagatcaactacaaggagtaccaagctgtcacacttgcttaccagcacaacaactctggctttgtgggttaccatgcacccactctccgtcagggtcaaccatacccagctaactacccatacccgcttattggaaccactgctgtcaccagcgtcacccagaaaaagttcttgtgcgacaggaccatgtggcgcatccccttctccagcaacttcatgtccatgggtgcccttaccgacctggggcagaacatgctttatgctaactcagctcatgcgctggacatgacttttgaggtggatcccatggatgagcccacactgctttatcttcttttcgaagtcttcgacgtggtcagagtgcaccagccacaccgcggcgtcatcgaggccgtctacctgcgcacaccgttctcggccggcaacgccaccacataa

SEQ ID NO: 110 - protein, 951 aa, Chimpanzee Adenovirus- ChAd 37 Hexon
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGTAYNSLAPKGAPNTCQWIAKGAPVTDQDNEEQELTDVTYAFGNAPVQAEAKITKDGLPVGLEITEDEQKSIYADKLYQPEPQIGDEQWHDTTGTNEQYGGRALKPATNMKPCYGSFARPTNKKGGQAKTRKIEKEENGVKTVTEEADIDMDFYDLRSQRANFDPKIVLYSENVNLETPDTHIVYKPGTDETSSSVNLGQQAMPNRPNYIGFRDNFIGLMFYNSTGNMGVLAGQASQLNAVVDLQDRNTELSYQLLLDSLGDRTRYFSMWNQAVDSYDPDVRIIENHGVEDELPNYCFPLDGVGPITGTYQGVEPDGNNGNWKKNTNINGANEIGKGNNYAMEINLQANLWRSFLYSNVALYLPDGYKYTPANVTLPENKNTYGYINGRVVSPSLVDSYINIGARWSLDLMDNVNPFNHHRNAGLRYRSMLLGNGRYVPFHIQVPQKIFAVKNLLLLPGSYTYEWNFRKDVNMVLQSSLGNDLRTDGASISFTSINLYATFFPMAHNTASTLEAMLRNDTNDQSFNDYLSAANMLYPIPANATNIPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYIPEGYKDRMYSFFRNFQPMSRQVVDEINYKEYQAVTLAYQHNNSGFVGYHAPTLRQGQPYPANYPYPLIGTTAVTSVTQKKFLCDRTMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 111 - DNA, 2817 bp, Chimpanzee Adenovirus- ChAd 38 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacgccctggcccctaaagccgctcctaatcctagccagtgggaggaaaccactactggaacggatggaaatgctgctactacaactacacatagttttggcctggctgctatgaaaggggacaatattacatctgacggtttgcaaataggaacagatgctacttctggagaggaaaaacccatctatgcagataaactgtaccagccagaaccccaaataggggaagagtcatggactgatactgatggaaccaatgaaaaattcggaggaagagtccttaaaaaggacacaagcatgaaaccctgctacgggtcatttgccaaaccaaccaataacaaaggtggtcaagcaaaacaaaaggcaactgaaggaaccgctgtagaatatgatgtagacatgaacttttttgatggtagagatgcagctgctaactttactccagaagtagtgttgtatgctgaaaatgtggatttggaaactccagatacacatattgtatacaaaccaggaacctcagatgtgagttcccatgttaatttgggacagcaagccatgcccaacagacccaactacattggtttcagagacaactttattggtctcatgtattacaacagcactggcaatatgggggtgctggccggtcaggcttctcagctgaatgctgtggttgacttgcaagacagaaacactgaactgtcctaccagctgttgcttgactctttgggtgacagaactcggtatttcagtatgtggaatcaggcggtggacagctatgatcctgatgtgcgcatcattgaaaatcatggtatagaagatgagcttcccaactattgctttcctattgacgctgtgggtattactagaacttatcaaggtatcaaaacgcaaaatggtcaaactacaacttgggaaaaggacaccagtgttagtacggccaatgaaataggcattggcaacaatcttgccatggaaatcaacatccaagccaacctgtggaggaacttcctctacgccaacgtggccctgtacctgcccgattcttacaagtacacaccggccaacgtcaccctgcccaccaataccaacacctacgattacatgaacggccgggtggtggcgccctcgctggtggacgcctacatcaacatcggggcgcgctggtcgctggaccccatggataacgtgaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccaacccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaa

SEQ ID NO: 112 - protein, 938 aa, Chimpanzee Adenovirus- ChAd 38 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNALAPKAAPNPSQWEETTTGTDGNAATTTTHSFGLAAMKGDNITSDGLQIGTDATSGEEKPIYADKLYQPEPQIGEESWTDTDGTNEKFGGRVLKKDTSMKPCYGSFAKPTNNKGGQAKQKATEGTAVEYDVDMNFFDGRDAAANFTPEVVLYAENVDLETPDTHIVYKPGTSDVSSHVNLGQQAMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITRTYQGIKTQNGQTTTWEKDTSVSTANEIGIGNNLAMEINIQANLWRNFLYANVALYLPDSYKYTPANVTLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 113 - DNA, 2781 bp, Chimpanzee Adenovirus- ChAd 44 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcgcccaatcccagccagtgggaacaaactgaaaccaatgttaataaaacacacaccttcggaatggcagccatgaaaggagaggctattgacaaaaatggtctgcaaattggaactgacgctgcggatcaggataaaccaatttatgcagataaaacattccagcctgaacctcaagtaggagaggaagactggattgacaaagcagatttttatggcggaagagctcttaaaaaagataccaagatgaaaccatgctatggctcatttgccaaacctacaaatgtcaagggaggacaggcaacgcccaggactaaagcagatggaactactgagcctgatattgacatgaacttctttgacccaaccactattaacacaccagatgtagtgttgtatgctgaaaatgttgatttgcaaactccagacacccatatagtttacaaagcaggaacttcagatgacagttctgaggtcaatttggctcagcaagctatgcctaacaggcccaactacattggtttcagagacaactttatcggacttatgtattacaatagcactggcaatatgggtgtgctcgctggtcaggcttcccagctaaatgctgtggtggacttgcaagacagaaacaccgagctgtcctaccagctcttgcttgactctctgggtgacagaaccaggtatttcagtatgtggaatcaggcggtggacagctatgatcctgatgtgcgcattattgaaaaccatggtgtggaggatgaactgccaaactattgctttcctttggatggtgtgggcactaataccgcataccaaggcgttaaagttaagacaactaatggaaacgacacgtgggaaaaagatgaaactgtttatgagtttaatcaaattggaaagggggatatctatgctatggaaatcaacattcaagccaacctgtggagaagttttctctactcgaacgtggccctgtacctgcccgattcttacaagtacacgccggccaacgtcaccctgcccaccaacaccaacacctacgattacatgaacgggagagtggtgcctccctcgctggtggacgcctacatcaacatcggggcgcgctggtcgctggaccccatggacaacgtgaaccccttcaaccaccaccgcaacgcggggctgcgctaccgctccatgctcctgggcaacgggcgcttcgtgcccttccacatccaggtgccccagaaatttttcgccatcaagagcctcctgctcctgccagggtcctacacctacgagtggaacttccgcaaggacgtcaacatgatcctgcagagctccctcggcaacgacctgcgcacggacggggcctccatctccttcaccagtatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaa

SEQ ID NO: 114 - protein, 926 aa, Chimpanzee Adenovirus- ChAd 44 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNPSQWEQTETNVNKTHTFGMAAMKGEAIDKNGLQIGTDAADQDKPIYADKTFQPEPQVGEEDWIDKADFYGGRALKKDTKMKPCYGSFAKPTNVKGGQATPRTKADGTTEPDIDMNFFDPTTINTPDVVLYAENVDLQTPDTHIVYKAGTSDDSSEVNLAQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGVGTNTAYQGVKVKTTNGNDTWEKDETVYEFNQIGKGDIYAMEINIQANLWRSFLYSNVALYLPDSYKYTPANVTLPTNTNTYDYMNGRVVPPSLVDAYINIGARWSLDPMDNVNPFNHHRNAGLRYRSMLLGNGRFVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 115 - DNA, 2877 bp, Chimpanzee Adenovirus- ChAd 63 Hexon
atgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccccagcttcaaaccctactccggcaccgcctacaacagcctagctcccaagggagcgcccaacacctcacagtggaaggattccgacagcaaaatgcatacttttggagttgctgccatgcccggtgttgttggtaaaaaaatagaagccgatggtctgcctattggaatagattcatcctctggaactgacaccataatttatgctgataaaactttccaaccagagccacaggttggaagtgacagttgggtcgacaccaatggtgcagaggaaaaatatggaggtagagctcttaaggacactacaaacatgaagccctgctacggttcttttgccaggcctaccaacaaagaaggtggacaggctaacataaaagattctgaaactgccagcactactcctaactatgatatagatttggcattctttgacagcaaaaatattgcagctaactacgatccagatattgtaatgtacacagaaaatgttgagttgcaaactccagatactcatattgtgtttaagccaggaacttcagatgaaagttcagaagccaatttgggccagcaggccatgcccaacagacccaactacatcgggttcagagacaactttatcgggctcatgtactacaacagcactggcaatatgggtgtactggctggtcaggcctcccagctaaatgctgtggtggacttgcaggacagaaacaccgaactgtcctaccagctcttgcttgactctctgggtgacagaaccaggtatttcagtatgtggaatcaggcggtggacagctatgaccccgatgtgcgcattattgaaaatcacggtgtggaggatgaactccccaattattgcttccctttgaatggtgtaggctttacagatacttaccagggtgttaaagttaagacagatacagccgctactggtaccaatggaacgcagtgggacaaagatgataccacagtcagcactgccaatgagatccactcaggcaatcctttcgccatggagatcaacatccaggccaacctgtggcggaacttcctctacgcgaacgtggcgctgtacctgcccgactcctacaagtacacgccggccaacatcacgctgccgaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaa

SEQ ID NO: 116 - protein, 941 aa, Chimpanzee Adenovirus- ChAd 63 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTSQWKDSDSKMHTFGVAAMPGVVGKKIEADGLPIGIDSSSGTDTIIYADKTFQPEPQVGSDSWVDTNGAEEKYGGRALKDTTNMKPCYGSFARPTNKEGGQANIKDSETASTTPNYDIDLAFFDSKNIAANYDPDIVMYTENVELQTPDTHIVFKPGTSDESSEANLGQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLNGVGFTDTYQGVKVKTDTAATGTNGTQWDKDDTTVSTANEIHSGNPFAMEINIQANLWRNFLYANVALYLPDSYKYTPANITLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 117 - DNA, 2811 bp, Chimpanzee Adenovirus- ChAd 82 Hexon
atggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacttactttgacatccgcggcgtgctggaccggggccctagcttcaaaccctactccggcaccgcctacaacagcctggctcccaagggagcgcccaattccagccagtgggagcaaaatgaaaacaatggtcaaggtcaagctaagacacacacctatggtgttgctgctatgggcggacttgatattacaaaagagggtcttaaaattgtaactgatgctagtaaggaagatgacaatgaaatttatgcagataaaacatatcagcccgagcctcaaataggagaggaaaattggcaagacactaaaaacttttatggaggcagagctcttaaaaaagataccaagatgaagccatgctatggctcatttgccagacctaccaatgtgaagggagggcaagccaaagtgaaaacagaagaaaatgttcagtcatttgacatagatctggctttctttgatattccaagcaccggcacagggggcaatggtacaaatgtaaatgataagccagacatggttatgtacactgaaaatgtgaatctggagacgccagatactcatattgtgtacaaacctggaacttcagatgacagctctgaagccaacttgtgccagcaggccatgccaaacagacccaactacattggtttcagagacaactttattgggctcatgtattacaacagtactggcaatatgggggtgctggctggtcaggcctcccagctgaatgctgtggttgacttgcaagacagaaacaccgagctgtcataccagctcttgcttgactctctgggtgacagaacccggtatttcagcatgtggaaccaggcggtggacagttatgaccctgatgtgcgcattattgaaaaccatggtgtggaggatgaattgccaaactattgcttccccttggatggagctggcactaatgctgtataccggggtgttaaagcaaaagataacggaaactgggaacaagacacaggcgtttcaagtattaaccagatatgcaaggggaacatctatgccatggaaatcaacattcaagccaacctgtggagaagtttcctttactcgaacgtggccctgtacctgcccgactcttacaagtacacgccggccaacatcaccctgcccaccaacaccaacacctacgattacatgaacggtcgggtggtgcctccctcgctggtggacgcctacatcaacatcggggcgcgctggtcgctggaccccatggacaacgtcaatcccttcaaccaccaccgcaacgcgggcctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccaggggcagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacacccttctcggccggtaacgccaccacctaa

SEQ ID NO: 118 - protein, 936 aa, Chimpanzee Adenovirus- ChAd 82 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQNENNGQGQAKTHTYGVAAMGGLDITKEGLKIVTDASKEDDNEIYADKTYQPEPQIGEENWQDTKNFYGGRALKKDTKMKPCYGSFARPTNVKGGQAKVKTEENVQSFDIDLAFFDIPSTGTGGNGTNVNDKPDMVMYTENVNLETPDTHIVYKPGTSDDSSEANLCQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNAVYRGVKAKDNGNWEQDTGVSSINQICKGNIYAMEINIQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 119 - protein, 933 aa, Chimpanzee Adenovirus- CV23 Pan5 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTCQWTYKADGDTGTEKTYTYGNAPVQGISITKDGIQLGTDTDDQPIYADKTYQPEPQVGDAEWHDITGTDEKYGGRALKPDTKMKPCYGSFAKPTNKEGGQANVKTETGGTKEYDIDMAFFDNRSAAAAGLAPEIVLYTENVDLETPDTHIVYKAGTDDSSSSINLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDAVGRTDTYQGIKANGADQTTWTKDDTVNDANELGKGNPFAMEINIQANLWRNFLYANVALYLPDSYKYTPANITLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 120 - protein, 942 aa, Chimpanzee Adenovirus- CV32 Pan6 Hexon
MATPSMLPQWAYMHIAGQDASEYLSPGLVQFARATDTYFSLGNKFRNPTVAPTHNVTTDRSQRLTVRFVPVDREDNTYSYKVRYTLAVGDNRVLDMASTYFDIRGVLDRGPSFKPYSGTAYNSLAPKGAPNSSQWEQAKTGNGGTMETHTYGVAPMGGENITKDGLQIGTDVTANQNKPIYADKTFQPEPQVGEENWQETENFYGGRALKKDTNMKPCYGSYARPTNEKGGQAKLKVGDDGVPTKEFDIDLAFFDTPGGTVNGQDEYKADIVMYTENTYLETPDTHVVYKPGKDDASSEINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKDGQDGDVESEWENDDTVAARNQLCKGNIFAMEINLQANLWRSFLYSNVALYLPDSYKYTPTNVTLPTNTNTYDYMNGRVTPPSLVDAYLNIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 121 - protein, 932 aa, Chimpanzee Adenovirus- CV33 Pan7 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTCQWTYKAGDTDTEKTYTYGNAPVQGISITKDGIQLGTDSDGQAIYADETYQPEPQVGDAEWHDITGTDEKYGGRALKPDTKMKPCYGSFAKPTNKEGGQANVKTETGGTKEYDIDMAFFDNRSAAAAGLAPEIVLYTENVDLETPDTHIVYKAGTDDSSSSINLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDAVGRTDTYQGIKANGDNQTTWTKDDTVNDANELGKGNPFAMEINIQANLWRNFLYANVALYLPDSYKYTPANITLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 122 - protein, 960 aa, Chimpanzee Adenovirus- ChAd 3 Hexon
MATPSMMPQWSYMHISGQDASEYLSPGLVQFARATESYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQEETQAVEEAAEEEEEDADGQAEEEQAATKKTHVYAQAPLSGEKISKDGLQIGTDATATEQKPIYADPTFQPEPQIGESQWNEADATVAGGRVLKKSTPMKPCYGSYARPTNANGGQGVLTANAQGQLESQVEMQFFSTSENARNEANNIQPKLVLYSEDVHMETPDTHLSYKPAKSDDNSKIMLGQQSMPNRPNYIGFRDNFIGLMYYNSTGNMGVLAGQASQLNAVVDLQDRNTELSYQLLLDSMGDRTRYFSMWNQAVDSYDPDVRIIENHGTEDELPNYCFPLGGIGVTDTYQAVKTNNGNNGGQVTWTKDETFADRNEIGVGNNFAMEINLSANLWRNFLYSNVALYLPDKLKYNPSNVDISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLVQMLANYNIGYQGFYIPESYKDRMYSFFRNFQPMSRQVVDQTKYKDYQEVGIIHQHNNSGFVGYLAPTMREGQAYPANFPYPLIGKTAVDSITQKKFLCDRTLWRIPFSSNFMSMGALSDLGQNLLYANSAHALDMTFEVDPMDEPTLLYVLFEVFDVVRVHQPHRGVIETVYLRTPFSAGNATT

SEQ ID NO: 123 - protein, 937 aa, Chimpanzee Adenovirus- ChAd 6 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTSQWITKDNGTDKTYSFGNAPVRGLDITEEGLQIGPDESGGESKKIFADKTYQPEPQLGDEEWHDTIGAEDKYGGRALKPATNMKPCYGSFAKPTNAKGGQAKSRTKDDGTTEPDIDMAFFDDRSQQASFSPELVLYTENVDLDTPDTHIIYKPGTDETSSSFNLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLNGVGFTDTFQGIKVKTTNNGTANATEWESDTSVNNANEIAKGNPFAMEINIQANLWRNFLYANVALYLPDSYKYTPANITLPANTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 124 - protein, 956 aa, Chimpanzee Adenovirus- C1 Hexon
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGSAYNSLAPKGAPNTSQWLDKGVTTTDNNTENGDEEDEVAEEGEEEKQATYTFGNAPVKAEAEITKEGLPIGLEVPSEGDPKPIYADKLYQPEPQVGEESWTDTDGTDEKYGGRALKPETKMKPCYGSFAKPTNVKGGQAKVKKVEEGKVEYDIDMNFFDLRSQKTGLKPKIVMYAENVDLETPDTHVVYKPGASDASSHANLGQQSMPNRPNYIGFRDNFIGLMYYNSTGNMGVLAGQASQLNAVVDLQDRNTELSYQLLLDSLGDRTRYFSMWNQAVDSYDPDVRVIENHGVEDELPNYCFPLDGVGPRTDSYKGIETNGDENTTWKDLDPNGISELAKGNPFAMEINIQANLWRSFLYSNVALYLPDSYKYTPTNVTLPENKNTYDYMNGRVVPPSLVDTYVNIGARWSLDAMDNVNPFNHHRNAGLRYRSMLLGNGRYVPFHIQVPQKFFAVKNLLLLPGSYTYEWNFRKDVNMVLQSSLGNDLRVDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYVPEGYKDRMYSFFRNFQPMSRQVVDEINYKDYKAVAVPYQHNNSGFVGYMAPTMRQGQAYPANYPYPLIGTTAVTSVTQKKFLCDRTMWRIPFSSNFMSMGALTDLGQNLLYANSAHALDMTFEVDPMDEPTLLYLLFEVFDVVRVHQPHRGVIEAVYLRTPFSAGNATT

SEQ ID NO: 125 - protein, 933 aa, Chimpanzee Adenovirus- CV68 Hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTCQWTYKADGETATEKTYTYGNAPVQGINITKDGIQLGTDTDDQPIYADKTYQPEPQVGDAEWHDITGTDEKYGGRALKPDTKMKPCYGSFAKPTNKEGGQANVKTGTGTTKEYDIDMAFFDNRSAAAAGLAPEIVLYTENVDLETPDTHIVYKAGTDDSSSSINLGQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDAVGRTDTYQGIKANGTDQTTWTKDDSVNDANEIGKGNPFAMEINIQANLWRNFLYANVALYLPDSYKYTPANVTLPTNTNTYDYMNGRVVAPSLVDSYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

What is claimed is:

1. A recombinant chimpanzee adenoviral vector (ChAd) comprising the sequence of SEQ ID NO: 1, wherein the vector has a deletion or a functional deletion in the E1 gene in SEQ ID NO:1 and lacks E 1 activity; and wherein the vector optionally has a deletion or functional deletion in one or more of the E2, E3, or E4 genes in SEQ ID NO:1.

2. The recombinant ChAd vector of claim 1 which comprises a deletion or a functional deletion in the E 1 gene from bp 460 to 3542 of SEQ ID NO: 1.

3. The recombinant ChAd vector according to claim 2 wherein the vector further comprises a transgene encoding at least one tumor associated antigen (TAA) operatively linked to a promoter capable of directing expression of the transgene.

4. An isolated host cell comprising the recombinant adenoviral vector of claim 1.

5. A method for producing recombinant, chimpanzee adenovirus particles comprising:
 (a) transfecting a recombinant adenoviral vector of claim 1 into a population of cells; and
 (b) harvesting the resulting recombinant, adenovirus.

6. The recombinant ChAd vector of claim 1, further comprising a transgene encoding at least one immunogen operatively linked to regulatory sequences which direct expression of said transgene in mammalian cells.

7. The recombinant ChAd vector of claim 1, wherein the vector further comprises at least a partial deletion of nucleotide sequences which encode the adenovirus E3 protein.

8. The recombinant ChAd vector of claim 1, wherein the vector is completely deleted in E1.

9. The isolated host cell of claim 4, wherein the host cell is a 293 cell and wherein the cell propagates the recombinant adenoviral vector.

10. The recombinant chimpanzee adenoviral vector according to claim 3 wherein the at least one TAA is selected from the group consisting of: HER2/Neu, CEA, EpCAM, PSA, PSMA, Telomerase, gp100, Melan-A/MART-1, Muc-1, NY-ESO-1, Survivin, Stromelysin 3, Tyrosinase, MAGE3, CML68, CML66, OY-TES-1, SSX-2, SART-1, SART-2, SART-3, NY-CO-58, NY-BR-62, hKLP2, 5T4 AND VEGFR2.

11. The recombinant chimpanzee adenoviral vector according to claim 6 wherein the transgene is derived from an infectious agent selected from the group consisting of: HIV, HBV, HCV, HPV, HSV1, HSV2, SARS COV, *Plasmodium malariae*, Ebola Virus, West Nile Virus, Dengue Virus, Influenza A, Influenza B, *Mycobacterium tubercolosis*, Cytomegalovirus, respiratory syncytial virus, and *Leishmania major*.

\* \* \* \* \*